United States Patent 11,913,074 (METHODS FOR ASSESSING RISK OF DEVELOPING A VIRAL DISEASE USING A GENETIC TEST) - sequence listing, part 12

SEQ ID NO: 347 - DNA, 939531 bp, Homo sapiens
  source 1..939531: mol_type = genomic DNA
gtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtaatcacagtttgctttttctacctgtaaatgctcattggctttctgatttcccattaatttcctagctttaaattaccaagaattggactttttgtaaaataccaagttatcggaacaaagaccggcactctgggaaggcaaatgaaaaattccagtgtctctgtaactgagattgcctgttattagtaggtttctctgtctgtttggttttgtctacatttgaaaggaagcttttgaggaattcatggagcatgtctactctattccctcccaggtgagatggtgcccctccaggaaagtatcagaatgcagccattagggctggacatttctaactggccaagtctacacaggcataacaaattgagcaattgtggttatgatcacaatttctaaaactgggactctaaataataggttccagaagcaaattaaatatcaacaacccaattaccttttgtctctgctaccaagcatgaattctgatagtcattgtcttacttctctatgttcagagaattatatttaagggaagaagcagctaatgataatttactgattgttacaaacaatctacatgtcagctatatagagtcatctataggaattaattgtatgagctatatatgtcaggaatatatagagtattcttgacagtaaattagcattagcattaaaacgattagtattataattttataatactaattataactattagttaattagttcaactgttgagttgaactttctgcaatggtgggagtgttttatacctgagctttccaatatagtagccatgagccgtatgggcctactgagcatttgaaatgtgattagtgcaactgaggggcttttaaaataattttagttaatataaacttaaccccattgagtagtggctaccatattggacagtatacgtctataggccctaatctcatctcctctttaaaaagaatgaatatgtatctttattaataatctgtgttcatatcttatataacatacctaaaaatgtagacaaggcagggcgcagtggctcacgcctgtaatcccagcactttgggaggccaggtctggcggatcacgaggtcaggagatccagaccatcctggcgaacatggtgaaaccccgtctctactaaaagtacaaaaaaaaaaaaaaaaagttagcctggtgtggttcggacgcctgtagtcccagctactcgggaggcaggagaaaggcgtgaaaccgggaggccgagcttgcagtgagctgagatcgcgccaccgcactccagcctgggcgatacagcgagactctgtctcaaaaaaaaaaaaaaaaaaaaaaagtagacaaaaagcctacaaacagacacacccaactgttaagacctctcaggttgggattagaaaggtatgaagaaaggattttaacatcttgtcttgcctaatcccaaaaagaaaaaaaaataggtgataagattaaaaatgaatcaaataaatcagatgcaaccaattatatcatggaaccagttatgtcagtccatctctttgaattaaaattaaaggaaaaaagatggagggttctgacagttatctctctaatcgagacagccctctccctctctctgtccccttacagagaaagtgaatttgggagcttcggtcaaacatcccttgtctttcgtcaaattagtgcctaatgtcatcattttggtggctttcaaaggtgtgaaccagcaaacgggtgacagtgagaggaaggaacaagcatgtgaacaaatgcgtgaaccacagtcagtctctgaatggaaatccatgtgtcttatgaaaatcagttattgttgaaagccatttgcaaagcttccacgatcctcgcttggctggtgcacggctgtgagtgcttctttccaagtctcctgtgggtgacggggaatggctaaccagggattgtgttcacaggcatatcgattccaagtctgatcacagccacaaatttctttcccaggttagtaagaagaaatcaacactttactttcttggatcatatgtttttaaacattagtactgaggaaataaagaaagggagagaggaagaaaaaagaagtacaagaaagaatacactgggctgggcgtggtggctcatgcctgtaatcccagcactttgggaggccagtgcagacagatcactaggtcgggagatcgagaccatcctggctaacacggtgaaacccagtctctactaaaaatacaaaaaattagccgggcgtggtggcgggtgcctgtagtcccagctactcggggggctgaggcaggag[135 bp omitted]caaggagaagcaacacagtgcaattctttaaagtgcatacaattaaaacacatagaagaggaaccttggctagaattacagagcttgatcaagtctcatccatggttgacactgtttgttggatgatttggacatttggagcctctctatgtggggagagttttctttatccctttcaaatcggtatgccatctctacatacctgaattattataaaggtaacaaggttataagctcccccatgcctgccaggatgcactgctttgctgtgactgagccacactaggtgctaaacttttctgcactaatgcaatcaaattagaagttaaatctgatactgtaacaagttaccacctgggaacagaaatgctttgctgttttattttttcttcgtagcattgtgaaatgaacatggcatgtggcacattttaattacagcaaatattaatttttaatgggaaatgtacacctggctttgtattgttcataaattatctgagaggttgaaatttatttacgtgattttgatgcagttgtaattaaagtgaagaaactaatagccttctgtaattgaaggcacattaatctgaaagctacctgagggcagggattctgtgttaaccgtgttgtatactcaatttagtaaaatacgagtcttgggattagtggtcttgtatgcgatgtgctacacattttccagatatttctagggtattttctgagctttagaaaagtgataatatgatctagtactgtaggtaattatgtgctaagaaaagaggattctatcacattatctggcattgcttttttagttttgtaatggagtaattgattagtactactgcattttagcaaggtattttgctcctatacctagtggatgatgtttaagttaactctatttgtgtgtccctgagaaagagaaccgaggcaggcgctcggggaatggaacagggacaaagaaaccaaccaaataacactaggtatcagttttcagctgcatgtaaactcaacttattttttaatgattttattaggaagctttctacattctattttgtaatgcatttccctgagggaactttagaccttgcaggcctgtttgcaattcctgtcagattaggggggaaagaaagagaacagaatgatggaaatttcacacgttattcagtgttttaaaaatccagtttcttagcctgacagtttcttaaatctgtagaccttgatgttttaatcttatgcattctgatggagcttgatattcataactggtgggcttggtaaatttttaatcaggaagttgaatatgatgagaaaacacaaggggaggtttgtgttttgcaccttgtcatcaagctttccagtttcattttcactttttgcactaagagtattcctcagaggtgtcagagctgcccaaagctgacttccatccatattgaaatgactttttctgagctttccaaaattccaatttcagtgcaggtggtaatatctgaatgtgagcagcagaataaatagcagtttaaaactcatataaatatacatttatgctccatgtgtgaactcataaggtgtgggataaatcttgtcatttcaacataaacggaataacaaatagattgaaagtgggatgcactgttgcgaatacatgatctggatgcgcagtgcgattaaacagtgatggcttcatgagaatcgaatttcaaagatcacacaatcgattaaaacaattcagtctccctggtcatttttgtcagtaaattaaaacattaatttcatcccaagaatgtttttcagtgttttttattgtacaaagtaacaaacacatgcaaaagtagagaatagtaacatgattcctcatgtacccatccccagattcgataattaaaactcatagccaatcatgtttaatctatatccccacttgttttctccacattcctgaattgttttaaagccaaggccagacatcacacattttatccataaatgtttcagtatgtatctctaaatataattacacccaatccttcaacattaacattgattccctaagatgattaatatctgatcgctgttcagattttcccagttatcttacatatttataaagtttccttgaactgaaatccaaacgaggactatagaatgcaattagttaatatggctagagttccttagtctataaagagtaaagaactttccattcatattttactctcttttttcttagaattcttaaattaaagaaactagattgtcttcctgagtcttttgtgaaaaatatgattgtgaattttcttgtttatcgcacacaataaatccaccttataaattattgattgaaccaataaaacctatcaaaacaatttaattgaatacacatacaccacacactctagttttttttttatttttaatttttatggttatggaagagttgtacatatttatggggacatttttataaaagcatacaatgtgtaatgatcaaatcaaggtaattgaagtagcctaactttaaatatttatcattttgttgttttgcaaacattccaaaactactactctagttattttgaaatatacaatgcattattgttaactatagttgtcctattgtgctagtgaatactggatcttatgtcttttatctaattgtatttttgtacctatgaatttacctacttctaactcccccttgctctcaactccccttccttgcatttggtaaacattattctactctgtatctccatgagatcaatttttttagctcccgcatttgtatgagcacatgcaatatttgtctttctgtgcctggcttattttagttggcatcatgtcctccagttgtgtctatgctgtttgaaatgacaggatgtcatgcttttttgtggttgaataatattccattgtatgtatgtaccacattttttcattcggttcatacattggtggacactcaggttgatttcataacttggctgttgtgaagagtactacaataaacatggcagtgcacatatctcttctatacactaactttctttcatttgaatatatacccaacagtgagactgctaaattatgttagtgttagttttagttttttgaagaacctccatactattctccagagtggctgtactaacttacgttcccaccaatagtatacaagggttccctcttctccatatccttaccagcattcattattgcctatctttatttatttatatatatatttatatatatatttatatatttttatatatttttatatatacttttatatatttatatatatatttatatatatttttatatatacttttatatatttatatatatatttatatatatttttatatatttatatatatatttatatatatttatatatttatatatatttatatatatttatatatatttatatatatttatatatttatatatatttatatatatttatatatatttatatatttatatatttatatatatttatatatttatatatttatatatttatatatatttatatatatttatatatttatatatatttatatatatttacatatttatatatatttatatatatttacatatttatatatatttatatatttttatatatttatatatatttatatatatatttatatatttatatatatttatatatatatttatatatttttatatatttatatatatatttatatatttttatatatttatatatatttatatatatatttatatatatttacatatatatttatatatatatttatacatatatatatttatacatatatatatttatacatatatatatttattcatatttatatatatttatacatatttatatacatatttatatacatatttatagatatatttatacatattatatatatttttatatatatttatatatatttatatatatttatagatatatttatatatacatttttatatatatttatatacatttttatatatatttatatacatttttatatatttatatatacatttatatatatttatatatacatttacatatatatttacatatttatatatatttatatatatatttatatatatatttcttttttgttttttgttttttagttgttggtttcttttctttcttttatatatgtatatatctatattgcctgttttttcagagagctattttaactggggtgagatatttcattacaattttgatttgcatttctctaatgattagtgacgttgagcatttttccgcataccttttggtcatttgtatgtcttcttgagaattgtctattcagatgtttgctcatttttatttggattatttgggttggggttttgtaccaagttgtttgagctcctcacatgttctggcagttattctcttgtcaggtgggtagttggcaaatgttttcttccattttgtaggttgtcttatcacttgtttgtggttgcctttgctgtgcagacactttttagcttgatgtgatcccatttgaccatttttgctttggttacctgtgcatttggtggcttactcaaaaagtatttacccacacccatgtctggaagcatttccacagtgttttcttgtaatagcttcattggtccaggtcttacattaaattctttaatccgttttgatttgatttttgtagatggtgaggaatagggacatagtgtttggtcttcattatgttgatatgatatgtcacatttattgatttgtctttgttgaaccatccttttatcgcaggaatgattcccatttgatcatgatgaatgatctttttaatatgttgaatttgattcggtagtattttgttgaggatttttgcattcatgttcatcagatatattagtctgaagttttcttttttcgttgtgtatttgtctagttttggcattaggataatcctgatcctgtagaatgagtttggaagtattgtctactccttgattttttagaatagtttgaatagaattggtattaagtcttccttaaatatttggtagaattcaacagtgaagccatcaagtcctggccttttctctggtgagaatctttttattacttcttttatagcattacttattgatttatccatgtttactattatttcatgtttcaatctttgtagttttttatgtccaggaatttatccatttcttccagattttccaaatcgttggcctatagttgataaaaatactctctaatttacctttgaatttctgtggtatctgttttaatattttcttagctctgatttcatatatttggacattctctcttttttcttagcgtggctaaaggtttgttgatttcgtttttattttccaaaaacaagtttttattttgtattttctctcaatttcatttatttctgctctgatctttagtgtttcttttctttgactagttttgggtttagcctgctcttacttttctagttctttaagatgcagttttaggttttttgttgctgctgttgttgttattgttgttttttatacggagccttgctctgtcactgggctggagtgcagtggtatgttcttggctcactgcaacctccgcctcctgggttcacgtgattctcctgcctcagcctcccgagtagctgggactacgggcatgcaccaccacacccagctaattgttgtattttcagtagatacagggtttcgccatgttggccagggtgatctctgtctcttgacctcgtggtctgcccacctcgggctcccaaagtgttttgttttccttttttgatacaggcatttattgttataaactaccatcttagtactgcttttgctgtatcccataggtttcagtatgctgtgtttctactaaatttccttcttaaattatttaattcatccagtagttattcaggagcatgttatttaatttccatgtatttatatagtttccagagttcctcttattgatctcttcatgttttctattttttcatggttcaatcttggtaggaattttatgtcccgggatttttatgtccaataaatgcttattgatttctagtttcattccattgtggtcagaaaagatacctgctatgatttggatttttctgaatttctgagacttgtgtttcggcctaacatatggtctaccctggagaatattttatgtgcccatgagaagaatgtgtattattcagctatcgaatgaaatgttttgtaaatgtctattgatcaatttgttctgtagcgcacattaagtcagatgtgtctttgttaattttctttctaggttttttgtccaatgctgaaagtggtatgttaacttagcattcccaactatcattgtgctggggtctgtttctctctttatctctaataatatttgctttatatatctgagtgatccagcattaggtttatatatatttacagttcttatatcctgttgctgagttgacttctttatcattatataatgaccttctttgtctctttttacagattttgtcttgaaatatattttatctggtataagtacagctctttatgttcttttttggttttcatttgcatggcatatctttttctgttctttcattttcagtctgtgtgttttcgtaggtaaaaatgagttccttataggcagcatatagttgggtctttttaaaaaaaaatttattcagctagtctgccttttatttggagaatgaagtccgtttacactcattgttattattgataggtgaggacttactaccgccatttagttgttttttgttgttgttgtcattttgttagttctctcttcctttttttttttcttcttgtcttcctttctatataagcaattttctggtaatgttttaatttctgtcttttaatttttttgtgtccctgttaaaggtttttgctttgtagttaccatgaagcttgcaaaaaaaaaaaaaaatcttataaccaattattttaaattgattaaagcttaactctggtcacaaagaaaaaacattaaaaaggagaaaactaaattctacgctttatctccatctcctgcagtctgactttttgctatctctgtcttttttactgtctttcaacaaattgttgtagttattattatttttcataggtttgtcttttagtcttcgtactaaagatatgagggctttacatacaattataatattagaatattctgtatttatttgtgtgcttgcttttaccaaggagctttagaccttcaggtaatttcttgctgcacatttgtacccctgtctttcatattgaagaactcccttcagcattccttataagacagatctagtgttgatgaattacctcaggttttgtttgtctgagaaagtctttacttctccacgtttgaagcataactatgctgaatataatgttctagctttgaaagtctttttgttcagcactttaaatatgtcatcccactccctcatggcctataaggtttctgctgagaagtctgctgacaaacatttggacttctttatattttctttgcttattttctcctgctactcttagggtcctctttttgtccttaacctttgagaatttgattattgtatacctctgggtttcatctgcttggtgttgcttgactttcttgtacctggatattcactgggtttgaaaagttgtctgttatttttttgaataaactttctatcccaatctctttctctacttcttcttcaaggccagtgactcttagatttgccgtttttaggttattttctaaatattacaggcatcttttgttcttttttagcttctttttttctctacagactgtattttcaaatagcctctctttgagctcactgattctttcttctgcttcaccaattttgctgttgagacactctgatgcatttttgtgttgttgattgcattcttcagctctgcaatttctgtttgatttttttgttattataatctctttgctagatttatctgatagaattccaaattcctcttctatgttatctccaagtttgttgagttttctcaagacaaccattttgaattgcctgtctgagaggtcacatatctctgtatctctaggattgatcactgatactttatttagtccatttggtgaggtcgtgttttcctagatgttctccttgcatgagggcatttgttaatgtctgattttttttttttataaaggtgctttattgtgtggatagttgttcaatttggtgttcctgtggtcgggggttgtggggaagtaaatccctggaattttctatttagccatcttgttccacctcatatatttcattgttttaagaaaaatgagtagaagttgaaagagttgtataagagctaagtgaaggtcggctggagttattgtcaccaagcactcttctaagttgcttgaaaaatagcacaagcagtgtttcttaactgctcatataggggatctttcttccttgggtaaactcatggttggcattgacattgatttgttgcacttctgagtgaaaaaaaataggcatttaacataaaagagattactcttaggaaatactggatgtgactttagaaagtggtcatggttccttccaaaaatattcattattaaatatagtgttatatttcatttctgaacaaagagatctacgagatctggtctgctctggagaaaaaaaatgacaaaggagagaatttgagggaatctcccagtccgttcgtaactaacataagagtttatgcaaaacaagaattattctaaacaccatggatggtgggccataagccatctcatttatccagacatctctgtggttcagcaaatttcccagttgccctgtgtatagagcttttagggagtggagttattgttgctaaggagaggtcactgtttttaggctgggcaaaactgcattgatccttaggaagaatctagactagacaattggcaataaaagccatttgcatctgggcaacacctttccatcctaccttccccaaagcacactcagcagtagttcctcttaccacttaaataaaaacttcaacatgtggggacaagttttccattaaataagctatttttcctttgttttcaactgcacaataaccatcagaaacacttacctaatatttatttccacgttccatgtaccatgttccatgtgagcatgttacagccactgtccagtttaatatcatatgaatatgaaataccaattccactattgttatcatcattttccagatgaggataccaaacaaatgcaggaaacaatgagagcatgatgagaacttactttagaatacagagctagaattagactcaaagtccattagactctaaaactgatgctgctcctcaggctccgcttagcatttacaaaaaatggcactgtgactgaggaaccttgtgtacatgcatgtgacttcccaggtggcacttaccaacagaccatccttccaaatagctgctccttaaacaccccatcttgagcttagagacacacacaaatggtagtgtctgcactggggaggatgtacctggggcagaagcctgttcagggcctggagtgggctttgtcactttggcaaaagtctgcatgactttgggtccccctaaatgaatggagttcgggggccaggcgaagattcccatgaccctgttgactcctcattccttggggaggggtatgtcagaagagggtcagaactggaccctcacaagtatgggcctggccaggagacggggctttttggctctgagatctcttaaccacttgttataattcttcccacattacaaaggcccacaatgtacccccacaatgaggagagtccctgttgtcccagacagcattattcttcttgtacctttgggcttcatgcatcatttttcaggaggtagatcaagtggaagaaacatttttacagggaaaaagcagaaaaataacaacaaagagctgtgtagccccttaaaagactgtagctgtgaacatttcagacagagttcagagatcctggaaaggaaacagtaagccaaaaaacctctccaaaaattaataataaggacaaagctggttcccctgatccttatgaaggggatgaggagaatggatggtgctctgtgcgcatttagaggtcaagtaggtcaacaaagttctgttttccctgaatggggaccctagcactacggtgctcccatctagctctttccttaaacagttggaaatgagatacttaaagaaactccacccaatggaagtggacatgaggtcacatcgagggtcatggtcacaattgactaaaagggtagggaattgatttgaggatagcatatttcagaccagaaggaagagaattgcttagccggcaggcttttttacttttaaaaaaaaaaaggcttattgactcttagggaccttatctgaaagtgtcatgaccatgtctccctctgcacaggtcacccatctcactaaaaacttcctgctttggggttcaggttggaatgtcagaaatacattagttgatttgaattttgaatacgtgaaaagaaagcatccctcatagattgtaccttcaccgaaatgcaatgatttcctgccccaattgagtgctctccaagaaacgttgatgaaacatttatcagatgtgtggagtgaaggtcgtatgtggcacgcttggacagaaataagctggataaagcaggcagcattctctatgcagttccctaactgatcggcccgttctaggcagcataatcttaagagcaaaagccaggttggtcctgccatgttcgtgtattcatcaataacagcacataaagaagttctttcaacttaggattttatgcagaaacggtgaaatgattaacatcagaaatagcaacaatgccgtgtgatttccaaaattattttatttttctcctggttatacagttagagtgtgaattggagtctccctgtggttaagttgaagttgtgtgactgtatgctgggcaatagaaattgggtgtaaactgtattaatttgtgccaattccagatttagccgtaaatcacctgtgacacccttcacagtctctgttctccatccactgtgaccttggaggccaggttttgaagacacgttattacaagatgaaagagattgcatccctgagtgattcatgatcgtagcattccattgattactctaaaccaagctgcaaatgagcacagagcttctgctggcttaatccccaaaacctggagttgtaaaggacttagtcttcctccataatacaacttaatccacgtctactgaaatagaagtatatttatattctataaagttaacataagcgtaactcgatactatagagagaagttttaatattaatagccaatctgtcattactaaacagctggtgaaaggccaatgaggccgggcacggtggctcatgtctgtaatcccagcactttgggagtccgaggtggggggaccgcttgaggtcaggagttcgagaccagccagaccaacatggtgaaaccccatctctactaaaaatacaaaatttggcaggtgtggtggcgcatgcctgtaatcctagctactgggaaggctgaggcaggagaaccgcttgaacctgggaggcggatgttggagtgagctgagatcgtgccagtgcactccagcctgcaacaaaagtgaaactccatctaaaataataataataataaaataagccaatgaggtctgctgcatcatacctgttctgatttgaataggatgtcccttttccaaaattccccagcatctgcagagtattttattcaggttcaacacaagctggtgaggcatgtaactaccttgtaactagtttcataataattattatcgtctctctgaaaatagtcagcctgctttggacacaggtgctgcactgattttttttttattattatttatttattttttattttttatttttttgagacagagtctcttgctctgtcgcccacgctggagtgcagtggcgtgatctcggctcactgcaagctctgccttctgggttcacgccattctcctgcctcagcctcccgagtagctggaactacaggtgcctacgaccatgcccagctgattgtttgtatttttagtagagacggggtttcaccgtgttagccaggatggtctctatctcctgatctcgtgatccgcccgcctcggcctcccagagtgctgggattacaggtgtgagcgaccgtgcccggccccccactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaacttcccgagttcctcctagcattctctattctttccgccgcacaatgggacatgtggttttattccctgaaaagtcacttctggatggacccagtctgaagatggttctcctgctgtatagaaacatggatgtcgcgaaattgcctattaaacagggaagctattaaacagcctccctgaatttaccagattaggattttagtgaaaaattaccgcctgcccactgcttgtgggtagagtgttcttcagaagaaacattaaggtttaaagactgtaagtcatgaaatgcacgtgacaagatgaatgtcattgtatcatttcccaagccgcgatccccatggttcaccagaacttaaatacagcagttgatatttatagccagtggtataagaccttgtcttcaaggtggtgagtttccgctttgagatgtattccagaatgttacaatgttaaggggtcctaggtgttaatatcaattttataatttttaagacaaagaaagtgaagcgtgtggaaggcgagagaaacactaatggtgtcaagttggtattttagagagaagcagtcatttcattctcagttattacctatgctggttgtgcaaatttaagcaaattattgcactcaataggcgccattttctgtatccatagacagtggggactgtttgactcagtgctgtgcccatctttgcataaaaggcatttttacatttgtgtgcattggtgtgagttgtctgtttcttttgcccattttcatccttttcttgtttcattttctccatgtcttcgaattttcacagtaatttacacagaagtctgcatagtagtctcttagttttttaaaaaatcttctgtttgaatggtgatcctcttgtaatttctcattttctgtctttgtgctttctcccacctttttcttcattaagtggttagctactttttttcttattttcaaaaaatacccttaaaacatatgatttggtttattaattagatctataattattctcttccctaacttattgatttctggtcttccgtaacttactggtttcttacgtttatgaatcctttcttaagcttttttgtttgtttgaatttactgttatttttctaaatttttgagatggagatttaataaacttatttatatttttctattatattgaaatttttcatgctgtgaattttcttctggttctgatttaaatgtgactcttagattctggattttattttattctattattattattattattattattattattttatgacagactctcgctctgtcagccaggctggaatgcagtggtacaattttagcttagtgcaacctctgcctccagggttccagccattctcctgcctcagcttaccgagtagctggtattacaggcacccgccaccatgcctggctaatttttgtatttttagtagagatggggtttcaccatgtttgcctggctggtcttgaactcctgacctcaggtgatctacccacctcggcctcccaaagtgctgggaatacaggcgtgaggcactgggcatggcgccctccatcgttctttttgttttgtttgcatcatagtttgcaaagtgtggttctcctttcctatttagcctctattcccccaaaccattgttttcccaacactgccttctccaattcagcacatgtttttaagtctctttactgtagttaggactctgagcttcctgttctgtctgtcattattttcacttgtatggtggatgtgatttcagttcagtcttggctctccatccctcctcttcttcttctcctgtgtctctagaccctccttattcttgtcaaaagctcaggatgggaaataggaaaatagttctgctagagggtggtatttattttcaaatcacagttatttaactttatagttttgtgtgtgtcaccaaattatggtaaaggatggtatttgtgtggtttattttttcctgtttatctttttttttttgcaatggggtctgactgtgtcacccaggttggagtgcattggtatgatcttgactcactgcgtcttctggctctcaggttcaggtaatccttccacttcagccttctgagcagatgggaccacaggcatgccaccacaatacctgactaatttttgcattttttgtagggatggggttttgccatcttggctaggctgatctcaaactcctgacctcaagagatcctcccgcctcagcctcccaaagtgctggggttactggtgtgagccaccacacccggcctgttcttgtctatctttatagagttggcagaagatgctaggagattccagctgccattgactcagctgcatggaaattgcttttcttttttaatacattcattatatatgattagttattgattattcattttaaaatactttgcatcaaattatttctctttccaggcaggactggctgtctaataggtgcagccctgtgaaaatgaaagttcagggccccttcctaaaaaattgtaaagaacttcaagatggcgaaagtagagcatcacgccagtcacattggctcacacctgtaatcccagcacttcgggaggccgaggtgggtggatctcttgaggtcaggagttcgaaaccaacctggccaacatggtgaaaccccatctctactaaaaatacaaaaatcagccaggtgtagtggtgcgtgcttgtagtcccagctactcgggaggctgaggcaggagaattgcttgaacctgggaggcagaggttgcagtgagcagagatcgtgccacactgcactgcagcctgggggaaagagtgagagtctgtctcaaaaaaagcatcaaaccaggtgcaggaccctttgagtggcatccctgtgtgtacacagtcatacctccaggaaggtggtactggttcaatacttttatatattaagtaactcttgtttaataactttatatgtgttaagttatctaacacagagagagagagaactagagactggaacttaggagagccgaattctattcccaaatgtgtcttggatttatagtctgactttgaactctggagttctgttttcctacttgaaaaatgaaagattttaccctgaattgcgtttcacgaactatcacatatattactgataatacctaaatacattttaatagtggtattaattatatcacataaatagaaaaaaattgaaacacataaactatgctttttctgtatattttttcttagcaggtagttaaggtgagtaataacaaaacaaggtcaattttaaagcactattggagaattataggtgatatttagattttgtaagaattgtgaagattacataaatacatctaaagtttggaaaacgttgctcaggatgatccctaaggacgctttcaagtcctttcagcattttaggattctataattgcatatctttatgcagaattatgcattttttgatttagcaaataggtagatttaaatatataattaaaggtcaacctgttcataccttccagaaagactggggtgagatgaattccatatttttgtgtcatctaccaccacaaattttatttcaatttcatataaaggttaaaaattgagatgtccccatgtacactcaacgccatgtagtactgtgcctcctactacgaagtcagggttgcaaaaagccttcatgtaacattgctgtctatggtaacttgatgtcatgtctttttcatttctggttttcatgtctgttgtatctgacattctaaagaattcaaaatagattgttcttgaaggggatataaatagaagtgatgggccggcatggtggctcacgcctgtaatcccagcactctgggaggccgaggcagatggatcatgacgtcaggagttcaagaccagcctggacaagatggtgaaaccctgtctctactaaaaatacaaaaaattagctgggtgtgatggcgggcacctgtaatccaagctactagggaggctgaggcagagaattgcttgaacccgtgaggcagaggttgcagtgagctgagactgcatcactgcactgcaggctgggcgacagagtgagactccatctgaaaaaaaaaaaaaaatagaagcgataatgctgtacatctgttagccacttggatgctctctgccagattgcacaaaagttcatggtacgcctgctgtcaccagatttgggtattattttttaagaacccagaaattaaaacagataatatgatcctgttgatcaaacagtataatttttaaaaaggtactgtttgttaattttaagaacattccagtagaccgattggaggagaaatgtggtccccctgttaggcttagattttacataaaatttttaaagtgaaatttgattggagaagttgagttttttttccaaaatatgattttcttccattgagattgattggactctataggttcactgcaggagggtgggacattcttacctgttcgtaatacagaattctctgagagaaatatcccttcatctcagtgtctcagtggacattgttggtattcctgagtgttttgacattttggccatttccaaacatttctaggtctttgttattgacctgcctacatttcaattcttggcccttccctctgttttgaaatgactcattcttcacaagagcaaactgaaagctttactgttaagcaaaaaaagaaatcttgagccaaagtattataacttgctctgtaggaaatgaaaacagtgcattggccatcttttcaccctgttgttagagtatattaaattaaaataacacagcaagaaacattagtttccatgattcattttagatttatgttggtgtgtggatttggttggttgtttctttggttagtagaaggtgatgtattaaagtggaggtctggtatagctgatggaaatgagtttttttaaaaaggttatgaaacatctatctccctcttgagcagtagtccaggggagtgatcacatactgagatgaaaacaagagggtggtaatacagcaagtggtgtatgattcagtaactccaccggattgctttattggttaggtaatgaagcacgctagggaatttctatcaaacaggagtcaacatactgcccaataacatctgaaatgactgaactataagtttagggagcatgggatgaggtgtactgttaaatcgctcctatgctggaaagtgttccctaagttcttcccatcactacctggagaagttgatgcgggattactgggagaaggcttgtgacttttaggtcctctcagagctcttcactttgctccatgttgtgtgttgttttcttgttcgtgatttttttttttttttttttttacaatgaaggcattccaatcgggctaatacaaacatgaggcattctcaaactacaggaaattgctttccttaactacactctttgaaaaaaaatggggtttaattacctgctgcttttctattgctcagattcccttcaggatgcagggggagggatgggagagaagtttcctttgtgatttaatgtaattattcataatgactacatatggtcattttataagttcctaattattttaagtgattggtgcatggtcatttgcataggctgtttagcagaaaactcattcagtgacctacatataaatcatggaatagtttctaggcatgtaaagcgggtgagagaaaccaaacccttccccccatcacttatggttccaatgtatgcatcccagaatgtttaatgtaaatcataatagcagcttggatccagtattcttcatacaaatgtgtggttgatgtagggaaacatgtttaatgttttctttcagtagcagatggtacatggatttttatttgatgcaggcactgctttccaaggtaattgtcaagggcttttttccccctatgaaaaaaatggagggaaggcctctggatcaacccattcatttcacagatgagcaaactgagacctcaaatattgagtaattttccctaaatcaccagtttttaaacagagtgagggctaaaattcacatctcctgacagtcagcttaattctcttttcgtcatactgcacattttctcttgatagttgatgtgatatatgtcactttaaaaaaatgagtttccatttctgggtatattttatctactttcctcctcagaaagccaagttctgttgattcatagtaaggaccagatatttcatagtgctaattccaagctgggtataatttgtgacttctaggttacccacttgtgtccacaaaccacctaaattttttaattgtacacagtcaagtcaccttgatagaaggggccttgagagctcatctaattcagtgatttttccaacactggtttcagggctgctgatgtgctattgcatttcacccgagtccacaacaaaataagaagaaaaaaaatcagctctggggagttttgtcctcaagttaaattaattcccattttttttaagttacgtctttatcaaatgttgatgcttaaagagagacattgttggctgcgcacgttggctcacgtctgtaatcccagcactttgggaggccgaggtgggtgaatcacgaggtcacaagttcaagaccagcctggccaatgtggtgaaaccctgtctctactaaaaatacaaaaattagcctggcatggttgggggtgcctgtaatcccagctacttgggaggctgaggcaggagaatcgcttgaaaccagaaggcagaggttgcagttagccaatgttgcaccactgcactctagcctgggtgacagagtgaaactccatctaaaaataaaaaatgaaaaaaaaaaaaagatagtcatcgttgctttcttttattttcatgagaaaacaagaaatgacacatgtatgtcagctttccacaaaatcaccccctgccttccctttccttttatgttcttatgtttttattgtgtttacctgtcagtgaatccaaacattgagaaacattgggataagggaatgttattttctaggaaaccaaagttttaaaatatcatggttactgtattagtccattttcatgctgctgacaaagacatacctgagattgggcaatttacaaaagaaagaggtttattaggcttacatttccacgtggctggggaggcctcacagtcatggcggaaggtgaaaggtatgtctcacatggtggcggacaagagaagagagcttgtgcagggaaactcccattttttaaaccatcatatctgaagagacttattcactatgaagagaacagtgaaggaaagacccacccccgtaattcagtcaactctcactgggttcctcccatgacacttgggaattgtggcagttacaattcaagacgacatgtgagtgggtacacagccaaaccatatcagttactatagtcattttttggcaaaaccaagaaatagcaaacttgagcccgattccttaaaacagataaagcaccctaaccccccactgccaaatcaacactcttccactatatcattttccattttcaataaataactctttcatccactgtaaataacagaatagatgttgtctatgaattcactgcttaatatttcatttatctacttccttctacccttattcatacctatcctaaacacttttcaaaggaactttctctctgtctcttgttaaaaattttctcttgtaattcttaaatatgtacagatgttaccaattggtaagagattcttttttgatgaactttctctcctgggtacacatttatgatcctaaacgccccatgaagatgggcctacatctgccttccaacttcttctatgtccctcagtcataaatatctacattgtttctttgataaattttgggaatgatagaagacaataagttgcatgatgactgcttgtcttgttctttgttaaatgtacctatgtctccaccccctttcttccacatctcaaattggaaatcattgagtactaggagagagaggaaacagggcattccttagtgggaaaacataagatgccacgggcagtctaaatgtcaagatttggactgctggtctaaaaggtttccactctctgggttgctctagtgaagcaaataaatagagtaacacatcgatcctcccacaggtagaaggctctgctgttcgttgttttactactctgcagataggcagcagcagcagcagaatttgttagcaaggatcagtctgagtcgcctatgtttactaaggaatctgtccaaattggccgtgcctttgatggatattgttattcccccataacgctgtccttaggatcctggtaaatctcagaaatctctatacaaagttaccgtttcagagcaatgaatgtgggcaaaggtgaaaatcattatgaagcagagagtggagattattaacaggtggtcgaaagagagagcgagagaaagggggagagagatagagttgctttgttgcgcaataacatgaagataaaacagttaaacacatatatcctgtttcccccagtacaagcctaatgttgctgatttcaggttcctgtgacatcattcatttactgcacctattatattacaatgggggtaaaagaagcactttccattttcatgacagaagaaatgaaacagcaccagcattaacaatagcatactgggcactgtatctgttctccttggttctggaaaggtcctagagatttatgagtaaattggaccattccaactataggcattaaagttctggtgtttccaaaccacgttggctcttggggtccattatacctggttttatgatgtttaaaaatccaatatcatttggtaagaagtaacacaacattatgtctgcaatcatgagctctagaaccactcgacttgagttgctatcccatttctactaactggtagctagctgacttttggaaaggtacttaaactttctgtgtcagtattttcttgtctttgaaatggagatgatgatgatggtgatcacggtgatggtgatagcggtgatggtgatgatgggaatagggatgatgatgatgatgatggtgatgatgaagttgatagtgataaaacccaacacataggcatgttagaaagactataaatatatgccacacccttaaacagcatctagcacgcatttaataaataggtctcattgtgattagcagaacaaatgaaagcagggcgtttctagtctcttctctggtcgtgtccctaagagaaactggaggtgcctaagaatcactggggatactagtcccagagaagagttcctggatcctgttacatgcttcctgaatctgcatagattgtatctagaaacttgcatttttgataaactctgaaaaaggttaaattttgagaattgatggatttgggcaaacgtgaaagccattctgagacagaagaagtagaggctatcaccaggtggtcctgcttaatagatagggagagacagagagctgctatgttgtttaattcagaatggcagggagctgaaacattgcctaattctgaaccagacccctgatgcttaaataggaagcccagataacacccccaattctaactgcagccatgctaactaagataacagctgtctgtattcaaagacacatatatctgtgctttgttgactagtgcctttcgtttctctggccaaagcaaatgtgcttttttggctttaattttgtgcttttcactaattaagttgtttatatgaactaaaatatttatacacccaagataatgaaaataacccatgataaatggaacaaatggagtaaaagtaaagtagatttagtggcaccatagtttattgagcatctgtgattagattgtgttccctaggatgcttcggggagtgtaattcaatctgcagtttgaactgatgactcttcctttctgtagaggtttagagaaaaaaaatgaattcttgtttttaatatctcaagtttctcttcaaatggctacttgttacatcttggggtaggaggggagtcttttaggaaaaagaagaatgggtatattttgttgccatccaggagggagactgggcagaaaattaggctatatttggtagcttataatctaggatgtgtgaagatggggtacggtgactagctgatgcaggtgaatcccagaactggggctcagcttcgaagagttcttagctttgctcaggaaagaattcaaaagtgtgctgatggaggagagccagtttactaggggaaaccgtgcacagcaatatggctgctccatagacacagcagggccaccccacaggccgagtagcactcctggattgttggctagctgtatttctagctacttatcattatatgctattaggttggtgcaaaagtaatggcagtctttgtagttaaaaaaaggtaaaaactgcattgacttttgcattaacctaataaggcgtgagttattcgcaaactttctggaaaagagggagttcccagagccattcatgatggttaatattaggtgttaacttgattggattgaaggatgcctagagagctggtgaactattgtttctgggtatgtgtgtgaaggtgttgtcagaggagataaacacctgagggagcggcctgggagagaaagacccaccctcaatctgtgttggcaccatccaatcagctgccagtacagctcgtataaagcaggtggaagaaggtgggatgagctagtttgctgagtcttccacctttcgtctttctcctgtgctggatacttcttgcccttgaccatcagcctccaggttctttagcctttggaccgctggacttaacaccagtggtttgctagaggctcttgggactttagccacagactgaaggctgcgctgtcagcttccctgcttttaaggtttcgggactcggagtgagtcattactggcttccttgctcttcagtttgcagatggcttatagtgagacttcgtcttgtgatgatgtgagtcaattctccttaataaacttcctttcatatatattaaacacatatatcctattagttctgtccctctggagaaccctaatacaccatctaagataacttctgggcattgtcatggtgtcagtaaactgtcatggtgctggtaggattgtcttatgcagatgtattatcgttcctagtcctactggtttgggccaatttctttgcgacatccagttttgatcaacagggtattgaaaacaagtcttgctgttttcctgcctcataaccatgtctgtttgcccaagactgtcccagttttagcactcagcattgaaaacccagcaccctggaaacaccttagtcctgggccaaccagacgggctggtagtaccaaaagtcagggctacctatttttgtttttcatgcaataagttaaggaagtggtttcctactctaggatagtgcttctcactctttaacagtgataggcattgcctggggatcttgctaaatgcaaattttggttcaataagtctcgggtggggtcggagcatctgcatttctaataggcttccaggtgattcaaaagccgcccttccgtgcacgctacactttaagtaacaagcttctagagggcccggtaatcacctggccggatggttaaagagcaaattcaggataccaacattttttaattctttgcaattacttttttctctccctaaaatttttgccttttaaatcactggagtaggcccgtggacgttcagtttttcctaaaaagactccttttatcttttagataaagtacaaagtaagggtctctagaaagcagtagatgacaaagtagcttttgaaactaaaatctcatgtgagtgactgtataaatagcatacaaaatggaaggatttttcattttcttctggttgtttttctatgtagttggaagttaattcacttcaagtggaaatctggaaactagtttgctatccgtcttgcccctgtttgagtatctctcaagggtatctgacaacagtgtgggaaatcaataaatgtttgttcaataaatgaaaaagtgagaatcatttaattcaatgatacttaaacttgaacatgcacaaaaatcagacggaggacttgttaaaagtgcggattgccattcagtagatctggggattgacctattaagcatttctgatatgctcctaggtgatgttgatgtcttggaacacactgtgaatggcaagaatcaagattgaacatgcaaaaaaaaaaaaaaaaaagtaacgttacatatcatgtattttgccatgcaattaaaatgctgggaagtgtgatgatgattttgtcctttagaacatataaatgggatctacagttgagagagaaccatacaaggctcttggtaatggtcaggcttatgtatttaaggtgtaattgcatctatctttatactagttcctttcccttgggaactgctcagctgaagataaataagcaaaacgggcacatgtgtagcctaatagcaaatataaagattattgagccagtttatagtgactcaataaaattctgcttgtcatgggtaagcaaaagtcagggcccttgaaatttagggtgcagcaaaaggaagcccataattggggtggaggttggggagatggccaggagactcatgtgtccatcaggagacagctaattgggcaggaaaggtgtttctggaccaaactgagggtcacactgctatttctcgtggtctaataatgaggtgcagatgaactggggaggaagagagtttttatttctgtaaccagttacagggagaaggtctggaaaatattgccagaccgactcaaaattacaaagttttccaaagattatataccttctaagttgtatgtctacatgtaagtgtgcattcatctgaagacctaagtggttcatttattgtcatctgtacctaagatctgagtcctgaggaccttcatctggaccttcagtaaatttaatctaaatgggtctaggtgctggggtgattacccttatcttgtctcgtgctaatcatggaggttgggggagttcttttagaccccgcaataaacttgtttgtggaggcctggggagtttcttcagatcccagtaaaacttgtttaatcctaaacaagtcctgttaagaaatccttcagtatcttgtcaggatttaagccccaggaaaggcctgggcacaattctgggtgggctttggttgcatcccagcctttgtagatgggctctggctgcctcagcttttattatttaacttaaccactcagtcagtgccgaaacagtagttgtggaggcctgtgttagtgagacctgatttgccacacagggtcctgttgtgcttctctgggaatttcattgcttggatgttatttgacatttcccttttaacagttaatgttagaaagtccatgttatggcctggcgcagtggctcatgcctataattccagcactttgggaggccgaggtgggcacatcacctgaggtcaggagtttgagaccagcctgaccaatttggcaaaaccctgtctctacttaaaatacaaaagttactcgggcatggtggtgcacacctgtaatcccagatacttgggagggtgaggcaggagaatcgcttgaacctgggtggccgagattgcagtgagttgagattgtgctactgtactccagcctgggtggcagtgagactccgtctcaattaaaaacaaaaaaagtgcatgttatttgatggtttttatattcctttattcatttcggcaaaagccattcccccacgttgttgtaagaatctgattgttagatgatactcttgaagtaggctgacccaaaatatttttcggagacttggctatgaagaattttataaactaacttaagttgcctttcttttaaggagctgacatagtggaattgtgcaaagaagttattttagtttcccttagggttaaatatttattgaagagggaagatggcttcttccacaacaatttttattttctccttttctaatctgttctaaaagtcttttagctgccttgctactaggaaaagggacttactcatttccattgaactcaaaatgttactttgtgtgtgtgtttaatttccccatcacccactctgcagactcaaaacctctgagctagaccatgccttgattttttttttcttttaaatgccatgagttagacatttaaggacaccaaatgattgaaaatagtcgaaaatgttcacttgaccctcattgcctatgacattgctgttagctttctgcatgaaagtgcaaacttcaattttcaggaaggcccacatcccagaactggcattgtttccttagtcattggaagcagaaaactacagcagaagtgttgcctccagccgtacagagaagaacaatctgcaggcacaatctggaaacctttcccagtgaagggagaaagtgagagtggcgttctggccttggaaaaacaaacatttgttattactttcctagggactgaaatttttagctccccagtgcaatctgtgtataatctagatttccagatttcctaaatggaaaacagataaacaaaaatcagccttcttaaattatgtatggtggtaaaataaagtaactgagaaggaaacaggattcctaaaccgaatggactttagcaaaagaatctttcaccattaataatttctccctgaacaaatatgcagatattttaccagacagagaatagagactttgttttggcttatcttgcttaagagtaattctgagaatctattacttgtgagagaataagattcataaggaatgttcgttagagagttgtactgggagattcacaggctacatttctaattttttcctaaagaactccttttacaataaaaaaccatgctgtaagctgcagagtgttgctgaaatgtaagcttttaccattgttgtagatctggcatcttgtttagaacccatagtttcctaatatttgcacgttataacatatgaagctaaactgtatagtacataaaactcatacaattttttttttttcgagatggagtcttgcactgtcaccctggctagagtgcaatgacatgatctcagctcgctgcaacctctgcctcctgggttcaagtgattctccttgcctcaggcatccaagtagctgggattacaggtgcccgccaccatgcccagctaacttgtttgtatttttagtagagatggggtttcactttgttggccaggctggactcaaactcctgacctcttgatccgcccacctcagcctcccaaagtcctgggattacaggcatgagccacccagccctgccaatacatacaaattttaactccagggtaaattgataagacttcttccttcatggaagttaaattctaataggatccctaatgccccatctagccctgcagtatttcaggtcaacaataactctttgctgactgaagatttgactggatggtacacgccctccaatggaactaacaggctcaacagctctaggtgcataaataatcttcatcctacaaataaagaattctaaattggactctaaatattgtatgtggctactgtggaagctaggaagattgattggattaatatcaagtttcacaatgtgttctttcattaggatgtcagtaatgagaatgaactattcattagaacagccaactttctaaagaataagagtgctgacctcacacatgactggggcagaacagggtactgtttacttcatgagagccctagaatgggacgcagtggattgggggccgttccctactctattgccaagtatgtgcatttgccactctgacttcttataggtaaagtattggcagttatgtcctccatagtcaatttcattcttaaaaaggccatgtgtcccaaacattaactgaaaaacaaaaagcgagattcaaagacttctcatatgctgttggtcggagtgtaaattagttcattgtgaaaagcactgtgaaaggcaattcatcaaagatctgaaaactgaataccatttgacctaccagtcccattactgggtttatatgcagaggaatataaattattctaccataaagacccatgcacgtgaatgttcactgcagcattactcacaatagcaaagatatggaatcaacctaaaggcccagcaataacagattggctaaagaaaatgtggtacatctacaccatggaatactatgcagccataaaaaatgagatcctgtcttttgcaggaacatggatggagcttgaggccattttccttagcaaactatgacaggaacaaaaaaacaaatattgcatgttctcacttacaagtgggaattcagtgatttgaacacatggacacacagaggggaacagcagactttggggtctcctggaggatagagggtaggaggagggagaagagcagaaaaaaataacttgggtacttggcttagtacctgggtggtgaaataatctgtaccatccccataacatgagtttacctatgtaatgaacctgtacatgtacctctgagcctaaaataaaagttaaaaaaattctcacttcagttatcacattgaaaggaatacagatcatcagacaatgaagagcaaatcaaattattcctggtatctcttcgaggatgtttacaaggagggaagtctgttaatgaatgctgaaaacatgtgaaattatccttaccatcttgtccattctgcatgcctcacaatgtaccctcctttcttcaaggtttttccctccactgtaaagtctgaagtgtaacacccaagccatgtggagattttcacatcttcgctgccctgttgtcctcagcatctatctccgcctttctccttacagtcacacttggctctttccaacacgaatcactagcctttactttccctgttgtatcttctttactcattgctttagttctaaaccatagaattccaaaagccaagctggaaaaggaggagttaccttttgtgaggtgagaaggggaaaaactgtgggtattcatactcaaaatatttgctagttgcagctctataagaagtcatccagcagcttggagaagtatatggttcacaaagatgattcatccaagaaccagtttgaatatttagatgatttagagtggaattagttagaatagaaatgagtatagaattgccacaggtcacaatataagagaaaaattagcaaattaattaattggatgttgttctatagccagtatttgttttagagatttttatgaagtacttttccttcctgaaagtcattataaagctttgtagtaacctgataatgttgaatatttactttaatgtcatccaaaaaactatagagttttgaaagatggaatgagaaactggtctgtaataaggaaaaaccagaaagactgtaatacatttgcatctttttcaaattcatatgctaactagagctaacaaatgttaaataatttcagaaagtatctttgctgggcctattctgaccagtaaataaaagcatttgaatgagttcaccatcttacatggatagtctgtggagaagaaatggattttaaagagcctgaactagttcccagcaaatttgatcacatcattggttttttaaaacatgtcttttacctacacgcggtaacagatttgtattatatgcgctaaaatgataatattgatattaatgaggtgatattgtcttacatgtattaccaggggagcatctttctgttttttctccctttctttttctattttttctttgtttctttttctctttccttttcatttatatatataaataaatatataaatatatatatatatatatatttttttttttttttgagagaaagtcttgctctgttacccaggctggagtgcaatagcatgatctcagctcactgcaaactccacctcctgggttcaagtgattctcctgcctcagcctcctaagtagctgagattgcaggcacgtctcaccacgtccagctgatttttgtatttttagcagagatggggtttcagcatgattgccaggctggtcttgaactcctgacctcaagtagtatgcctgcttcagcctcccaaagtgctgggattacaggtgtaagccaccgtgcccagcctctttttttccttttaataaaacactggttacaatgtgagaaacagattggagattggacagggagaccagttaggagtctgttccagtagttcaagtgacagctgatgccctcttaaactaaggtattgagggagatgatgggaactaaacagcagattcaagagttctagggcatacaatgaagagaacttggcaataaattgataatgggaattttgagacaaggatgagtgagtccaagttgatttctgcatttagggttggttgactgaatggtggtgccattcacctggatgggaaatgctggaggaatgttggagtagcacacagggctggggtcctgagttctgcactcactaatgggactttgcttgtcctatgatattaagatgcatactatggcggagtgtggtggctcacacctgtaatcccagcactttgggagcctgaggcaggcagatcacaaggtcacgagattgagaccagcctggcgagcatggtgaaagcccatctccactaaaaataaaaaatttggctgggcatggtggcagacgcctgtaatcggagctactcgggaggctaaggcagaagaatcacttgaatccaggagatggaggttgtagtgagctaagattgtgtcactgtactccagcctggtgacagagcgagactccatctcaaaaaaagatgcttattatatatatagttctattgaatatgtatgttagtatatatatctagttctgttgaatatatattattgtgtgtgtgtgtgtgtgtatatatatatagggtataatatgcatatgtaatatatgcattatatataatatgcgtattgtaccctgtatatatatatgcatagaactatatataatatgcaaattataccttgtgtatatgtatatatactatcctatacaatagaactatatatatataatcatactcaatagaactagatatatataggatgtagcaatatgcatagaactatatataatatgcatattataccttatatatgtgtgtgtgtgtgtgtgtatatatatatatatatatatagttctattgaagtatgcactagcttccagcatgtagcctttatattctactgatgccccatcactttggaattacctcttatctttttctctcctgcctttctaatatcaccccaccactgattcccatctgattatgcctacttcactgaagcacccttgtcactcccttcaatgcctaaagtattgctttcttaagtgctatggaagcagagttccttttcttgcagtgaataaactacatcccaaggatctcaccccttgcttccccagtgaatagctctcagatggaaaataaaacagcaccattactctctgagattaagagggacaggtttgcatactcaacaaacattgtctgatggggaataactgccaaatttatcatctcagggtgttggtagttgttattttaatgtaaattttgaatagataatagattaatatgaatcttattttaccaggcagaaaaatggtatacagtgaagagtaatgcttcctccaacctctgcccccaggtaatactgttcttttctccacagacaaatacctggttatctctgggtctgggtattaactgtatctgtgtcttctcccagtcataacatacaatatctctaattcatagaaaatcactacctcttaccaagggaatacttcctgtaacacctttagcagggaacaatatcggataatcccaaagcaagatgttaacgcaaactaaatatgtcctgagaaggactctgtacttctatatttgagtccttgtggatgaactgtaacctagcttaatagacaagactgaaaacctgacttaggagtatgcacctgtaacaatagttgagtcttggccaatcccagccgccatacttcaaccacccatagactgctaagtgttcaaaaaaggcaaacaccaacctgtcaccagttcagctgtttgtgtacctcactgctgatttctgtaagtcatttccctttttctgtctatgaattttctttcaccaccttggctacgctggagtctctgaatctcatgtgattctgggggctgccttctgaatcgttcattgctcaattaaacttctttaaatttaatttggctgaagtttttctttaaccagagggaagaaataaactaatgtagattgcctctaagtgccagccactgtgccagacactttctaaaggtgcatttttaaagaattattttttaaaatttttgtggatatacacatagatgtattgatttatggggtacctgagatacaaaaatattatcttcctcatctacattgaagagctgtcattcaccccaggaggcagtgtggaataagtttctgtgcacctgagactatatcctattgtatatgaagccttcaaccaaaagtgccataaccttggtacagaattgctaccccatccgaagtccataggaacacagcatagaacaaactgaagtctgagaagttcaggtgagatacgtagagctgcagaagaggagtttttcattgtctctgaattggtctttctcagcgacagagttatttatgagatggggcaatcatagaaagcagtggcttttaaaaaacacttcagctgccaaaaatcttattccaattctctggaagagtgctgtcgtaccaagtgtaattcaccagtccggtgcctttctggaagttatgaaattggagagagttgcttttgtacaaatgaataaacaccaccaagatgagcctacccgcttgtcctgagttgagattgatatgatcagacatctagagcttgttctcctgggtgtctctctgaaaaaattctcttctctctcaccttttttttttttttctgttaataagtagacaatgctctggtctgatggggtctcaggaaggaaactggtatctatcttttcttgtcaacatttaccaacaaatatgcctcttatggacagggatagggattacggatcactctcattgtcttatgtgtgcaacttggagtggattgttagctatccagaaaatgtccatccctctttttcttggagaaattcactttttaccacattttgtgattcaaattggtctgtcactgaaattattctgaaaggttaaatgagacccatgagggccgtacaggaggcttccgtgcattttttcctctccttgtccaagtggtgaagaggtaggcacataaactaagcgtggacaatggtactttttcctgggagaaggatgactaaaaagatggcgacacaaaggtatctaattttccgttcatggcaccgttcatgagtcttgattctgtgaatgtccccatatgcccctccaaaaacctctttttttttccttaagttagccagttataggtttgtattatgagtttcatagtgctataaagagctataaagaacttcctggagactgggtattttataaaggaaagaggtttaattgacgcagttccacatggctgggaagtcctctggaaacgtacaatcacggtggaaggcaaaagggaagcaaataccttcttcacagggcagcaagagaacggagcaagagcagagagaactgcgtcataaaaccatcagatctcgccagaagtcactcactatcaggagaacagtgtgccgggaaaggtcgccatgatccaatcacaagcctccctcaacatgtggggattacggttcaagagctgatttgggtggagacggagccaaatcatatcaaggttcggttgcttccaaccatacacgtaacagatatttcactaaatgctattccagaacggatttacacaatttttggaaatagttacagaacacacacagaaaaactgatgatgataagataccccgaaaaacacacctgggtatttctttctgggatgttgtggctgagataccttgatagaaaagccgattttgctgagtaacttctaaggcctccaattctgaaggaagaattaagtgatatgagagtttggaaaataattgaagagacctgcctttgcaggaaataatataggcaggaaaaatcaagaatgccacaaaattgagtaaaagagaacaaaagaagagaaatagaattacctctcaactttgtaaaatagaattgaacccagtaatactggataagatttaaaaatattatggggtaggatcacttctattaaatgtgattagcttttagctagataacattgaatattttaatgtttcattggctattatacaatatatttttttcctctatgaatattgtaaaattcctgtttgatttaggagtcagggatgtttaagtgattatgtagctagtcctcagaccacagttaaaaaggtacttttgttttgttttctggcgttgggaagattagcaacctgggtgctagcatggaaaaggcacaggaggccagttacggtgcctcaggtctgtaatcctagcactttgggaggctaaggcgggtagatcatctgaagtcaggagtttaagactagcctggccaatatggtgaaatcccatctcttcaaaaatacagaaattagctgggcgtggtagtgcacgcctgtaatcccaactactggggaggctgaggcaggagaatcgcttgaacctgggaggcagaggttacagtgagccgagattgtgccattgcactcgagcctgggcaacacgagtgaaactccatctcaaaatataaataaataaaatacaaaatataaggcacagaaaaaaatactgaaataagttgcagactggaatttcttacagatgttgtttctcctcagcatgaacagaggtggccatgccatttctccagataaatagtgcagtacaagagtgttggttggtttcatgtatcaccatataaagttgtattatcagactccatatgatgaagaagccttcacgagaaactcactaccaaagcaaaatcgttttaaattaatgaatgattttcaagtaaaggccccataggattttttatttgtcctcctgttagaatgaatatctgtgaatattaagctcctcacatttcctgttttgttaagaaatttgttcaaaatgaaagtatctccctttagaccaagctaggacggtctactaacagaaccttagaaaggaaacacaatgcaaagtgccaattagcactgcaaagttttggttcagtttcttattttttattttttttgagacggagtctgggtcttgtcacccaggctggagtgcagtggcccgatctcggctcattgcaacctccacctctagggttcaagtgattctcttgccatagcctactgagtagctgggattacaggcacatgacaccacgcccagctaattttttttgtatttttattagagacagggtttcagcgtgttggccagactggtctcaaactcctgacctcaattgatccacccgcctcagcctaccacagtgctgggattacaggcgtgagctaccacgcctggccttggttcagtttttaatgcctaaatgtggtctaaatcttttaggacaagtgtggcctcatgcaacatggattgttggaggcctcatttgtgctcataagcggcattttccttgtggacctcctgttttactccattaggttttgcatacagcagtaccatagaagatggagcacttagaaatggtgggaagcccctgagtcctttgtccatcatgtcagagtgacgatgtttctagaggtcattgctgtctttctttggagactgggagaatagggaagtaaaggaagatgtttaaattccctacttctctcttttttgttagatttttaaataaaactttatttcacaaaagacctattgtcatggcaaccagtcaaacaatgctgatgtatatgaagaaaaccatgaatatattttcactcccattaaaaaaaaaaagtgcaacctaagttttcaggcctcacctttgtatggttaaatatcaggccacaatgacttcctataacaaaattgtgattatagcaaggatgattggctaattactgaaatttacacttctccggttccccagatagtattccagttctttctggcagtcctcaaaacagccatattccatgaaacaaccctcttcgtttctagcctccagttgaccacattcatgtaactgccttcagaagctgctgcttgttgcaattcccatcttgagaatgctcgtatgggttcccaggtgtcacctctgaatgttctcatggctctagtttggggaccccagctccttcttaggttttcttcagagacagggccaatggctctttccccagccctatgctatgatctgtcacctggtccctaaagtagctttgcttgtgctgaatctcactaagtgtctctttcatcttctgcatccaaacctctctctccacaggtggctcaaaatcaatctgaagaactgagtagggggtggatgcaattccttttcattttgaatttctttatcacctttccaagtcccatactctctcaccctatcaaaatcttctccctctgtccctagttataaaatcaaacctcctgggcatgccaatggcagcaggcacctgcagagatgcggaggattcctgaagaatgagtgaagggaggaggcgctgttgatacccccaacccctctggcttccatctgagctcagccagccccttgttaggtaatgaagggagataatggtccagactggttacatttccttcctcaagttacccagcaaactattaaccagtccttgctactaacactctcatcatggcactggcaatatctgaggaccggttcagtgatctgcacaaagggaaattagattcaaacataacaacttgtcctggagtgaaaagcagatgtataatttctctcatttgtccctactttatttaatagcccacatagggagcttatttaaaactcctagaacaacaacacaccaaacaagccaatattctgagatctcattgcatgatcaacatgatgataataactgttttcttctttcatgtaataacacagagagaaaattgtggtgggggggagggaggaggtctaagagagtcagaaatgtccttttctgatcttcaaactgaaagcaagaaagttgattaagacatagctcctgatcatgtcctaagtgtttccatttctttctgacattgttttccatccattcttacggtaaataatctctgtgtgtcaagcctgacattgggtggtagaagcaggtgggtgaacaaggtagatgtggcttctagcttcatggggcttagagtctagtgggagacaggcattgatcaaattaataatgacaatccttagtatgtgctgtgaagggaagttacactgatgagcatgatagatgcgaatcacagagattctcaagtaaatggcagttaaggacagagctgaatgacaggtaggggacaaagaggctaagggggaagggctcctccaagcacagggagcagcatgtggaaggtcttggaaacctgaggaagtgaagtgaaaagtccttcagtctggaaccctgggggagaggtggggctagagttgaggttggatagaagcagcacatcaaggggtttgggtttatgtcctgtgagtgtttctggaaaggggtcctgatccagacgccaagagagggttcttggaccttgcacagaaaagaatttggggcgagtccatagagtaaaatgaaagcaagttttttaagaaaatacaggaataaaagaatggctgttctacaggcagagcagtggtatgggccgcccagctgctcatccttatcattacttcttgattatatgctaaacaagggatggattattcatagtttttcccggaaagcggtaggcaatgactagaactgagggtttctccccatttccgaccatatagcgtaacttccgggtgttgctacagcatttgtaaactgtcatggcgctggtgagagtgctgttgagcatgcaagtgctttataattagcatatagtgaagagtgaggatgaccagagatcactctcattgccatcttggttttggtgggttttggccgacttctttgccacttgctattttattttctaggtctttgtgccccgtattgtgtgctgaactcctgtctcatcctgtgactaagattgcctaaccttctgggaatgcagcccagtagatctcagccttactttacctaaccccttttcaagatggagtcactctggttcaaacacctctgacattcgcagtggaatccattaaaagatgttaaggagatatgattatatttctaaattgtcactccagcatcccctacgccagacattatgccagtctctatccatacagtatctcatttaatcctcccgtcattaatctcattttaccaatgagtaaacttgaagcaaatgagtgactttctcaaggctacctacttacgccttaccagggccaggattcaaacctagacttgttcagcgacagaacacacacttaaccattacccactcttctctctggtccccagcaaaaagtctatagtttgcagccaaacctcattctctaattccaactacctaatagtttgctcttaatagttactttaagaggaaaagcttaattctcacaacatttgtcaacactcagtctgtttgaatgggtataatttaaaaaataatttacttccactgaaggaaagaaaggactgtcttgagaagtaagaaacttgaagatctttaagagtattaatattaaggttggcaaatcctttgagaagagtttctttctgcctattgtaccatttaaaaataatcggccaggagcaatggctcatgcgtgtcccagcacttttggaggctgaggcaggaggattgcttgagctgaggagttcgagaccagcctgtgcaacatgaggagaccccgtctctacaaaatttttatttttaattaggtaggtgtggtgatgctcacttgtaatcccagctcctttggagactgaggtgaggattgcttcagtactggagttcaagaccgtagtaagctatgatcacactattgcactcgcacttgagccacagggtaagaccttgttgcaatcaatcattcagtcaacaatcattgtgtcatgtctgcctgcctgttgaaaaagccttttagatgaaagtcaatcttcggttttgttgttgccagactggccccttcatgtaattttttttttttttttttaaagaaacagggtcttgttggccgggtgtggtggcttatgcctgtaatctcagtactttgggaagccaaggcggacagatcacaggatcaggagatgaagaccatcctggctaacacagtgaaaccccgtctctactaaaaatacaaaaattagccaggcgtggtggcgggcacctgtagtcccagctgcttgggaggctgaggcaggagaatggcgtgaacccgggaggtggagcttgcagtgagctgagactgcaccactgcactccagcctgggtgacagagcaagactgtctcaaaaaaaaaaaaaaaaggaagaaaagaaacagggtgttgttctgttacccaggttggactgcagtgatgcaatcatatctcactgcagtctcaaactcctgggctcaaacagtcctcccacttcaccctcccaagtagttgggactaaaggtaaataccaccatgcctagctgttttttttgtattttttggagagatggggtcttaactgagttgcccagggtggtctcatactcctgtgctcaagcgatcccactgcctctgcctcccaaagtgctgagatggcaggtgcgagtcaccatgctcagcctctttgacataatttttgcaaatcaatgaattggacttgacatctaggtgactgtggatacagaactgatgtattaacctttgacatggctgcaacctgctgagtaaaggctgatcccttgactggacctgttatacatcactgtccacttgattaggtgcaaggaactttgttgcagagattttaaagtggaatcagacacccaggtaacatacttctgaccaccttaatgtgtcatagcttcaaacacatttaaccaaagcccctctcccatgtacgaggaccctgcttacctgttagctgcgtgtgtcacccttctttagtgtctcatggtagaaataattcagttttaaaattaacttttagctggacgcagtggctcatgcctgtaatcccaacgctttgtgaggcagaggcaggcagattggttgaggtcaagagttcgagaccagcctggccagcatggtgaaaccctttctttgcttaaaaaaaaaaaaaaaaaaaaaaatttaactggatttggtggcgcatgcgtgtaattgcagctactcgggaggctgaggcaagagaatcacttgaacccaggaggaggttgcagtgagctgagattgcaccactgcactccagcctgggcgacagagccaaactctgtctcaaagaaaaaaaaaacaaacaaaaaaaactaccaacagtctacatgaaggttgtgtgtgttaagtacatctgttaaacttctaagtttctgacaaaaaccttattaactataactcaagaattcatgaagtcccctgtgaatgtgactcatatcagacaggagatcccaagcccttcatgaaggcttgcctcataccctgttcctgggccattgcccaaaaatctactgtgtctctctgttgggcttcagaatgagatgatctggttttaaacgcaggcctgccatcctcaagctaaatgagcatgggttagtggctaaactttttgtgtctgctctcctatatctcacatgggcataaaactatcttagatgtcatgatgtaattgcattattgtttcagattttccacccctccctctatggaagcccttttctaggttcctctggtagagtaccaggcatatggcttcctgccacagggatcctgctgttggtcctgtgacagtttggccaacgaaatgttagcagacatgatacaagcagaggctttagaagtaggtgcttgtgtagctggattcacctgtgtgtgcgtctttcattactatgagaatcatggtttctaaatgggtgtgacatacggagctcacctcacccatcccacaagtgggacttaaaccaagtttagaagaaatgaacttcatctgacgtacagatccatgagtggccaaaaagaaaaaaaaaatattattgaatgccagtgagagttttatgagtgagtaaatgccagtgaggtttgttatgtagttactaaagtggcaataatacaagctgttgtaagatttaaactctagttcccttttttcttctaaagttgctatggcactctcatttaacctctagtagggcatgtatcactcagcacctgtgatgaatagctgctattattcatttttccccccttcttctggtaaagccccttagtgtttctctagagaagtcctctcttccaccctcagtctgtgtcatcagatagaaaaagccccaagcttcacaagggggagtgtgatcgaggcctggccactgatgccatttcatcctcctggcctccctgactggtccgtgcctgggcatatcgcccaactcagtccaatgagattaaatctcaggaatttacatggaattctttggaaagagactcgatttcctctgggcatgctgaactgatagaatgaagtcgaaattttggtagccacctctccatgggttgaaaggcacctgtctgagaatcaaacttgacacagaggaaaataaaggtaagtaacagagatggactatcaacggcattgtataagcgacttgaatgagttctgtctgaatccaaacaccacagacttccggtttcaggatccaacaatttccatgtgggctatggcagtttgtatcatatatttgacccctgtgagccttgtacactggagtgtcctaacattctgtttatttccgtatagaaatcgtcttcattcctgtggttggcaatcctgcatcatttaactttgtgtctcccagtggaaatggcatagtcccttgtacatagcaggtgctcacttaggtttgaattattgcttagatgaataaataatattggtctacagtgaacacacacacacatcctttaacatggctgtagagtttaagttgcaaaaggtcatcttcagaaaccaaaaggtaggccgggcatggtggctgaggccagtacttagggaggcccaggcgggcggatcacctgaggtcgggagtttgagaccagcctgaccagcatggagaaaacccatctctactaaaaatacaaaattagccgggcctgttggcgtgtatgcctgtaatcccagctactcgggaggctgaggcaggagaattgcttgaacctgggaagcggaggttgcagtgagccaggatcaaggcattgcattccagcctgggcaacaagagtgaaactctgactcaaaaaaaaaaaaaaaaaaaaaaaaaataacaacaccaaaaggtatatagtataacaggtattaaaatctatttcaaagaaaggaacttgttgattacgacactggtaatttacagaagagcaagcatttgaatccagccctctgattccagtgtaacctacaatgtaagtgctttcctcaagcataccttacagagctctgcacatcagggagactgttcctgcagaggtgatgtcatctggtattttcactcatcctctggctgtgtccccacccaaatcacatcttgaattgtagttcccataatccccatatgtcatgggaggcacccaataggaagtaaaattgaatcgtggggcttgatttttcctttccttttctcataatagtgagtaagtctcatgaaatctgatggttttataaaggacacactgtctcttgcctgccgccatataagacatacctttgcttctccttcaccttccatcgtgattgtgaggcctccccagccatgtgcaactgtgagtcgattaaaccttttcttctttataaattgtccagtctcaggtatttcttcatagcattatgaaaatagactaatacgtcctcttaatcatcaaataatcttttgattccctaatggatagataggattgttcaggtaactgtgataggcccaacacagtggctcctataatcccagcattttgggaggctggggaggaaaaatcagttgaggccaggagttcgacaccagcatgggaaagatagaaaaaccgtctctacagaaaaagtttttaaaaagtaactgggtatggtggcgtgcacctatagtctcagctacttgggatggtgaggcaggaagattttttgagcccgggagttagaggctgctgcaagccatgatcacactactacagtccagcctgagtgacagagcaagaccctgtctccaaaaaaaaaacaagcaaaacaaacaaacaaaaaccgaaaactgcagtgcattctcattcttagaagattttttaagagcctctataggcctcaaatcgatgctaagtcagagacttattactgcaaaaggcctgtgaatgagcacagataaatggaccattggtacttccaaagaagccatgtagaagttaattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggaga[132 bp omitted]aaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactcacaagcaggtaaaaaataagggcaaatggtttttatatattgtctccaagtcattctcagaaaagatggctgaccctgaacaggttttgaggaggacagtccttctacatgggtgtagtgtgatgctcgcagtttgcagtatacaaagtacacagttgtggtaccgacagggctcgcattggagattcgacatcaccatgtgcttttgtgacttgtttcgtggttgaaaaaagcaaaatggatcccccaaggctcttcctacccagacccaaatgggcaagcggggagaaagctccctgaatgcctttacgttagatgctgttgggattcagagcaggtccccaggagggagccaatctgggtattcattccttagctgctgtaatactggcttgctaatggctaccagctctccactctccacagacctgagcttggccaaatgggaactgctttgcctataaggttatagagccctcaagagaaagccagcagtcaatgactgatcaaggtgcaaaaagaatagcccatttgtcttaaagagggtgttaaagcaaaccaaatatggcttgaaaaggactgcatacttctatatttgagttcttgtggatgagctgtcagctagcttaatagacagacaagactgaaaatctaacttaagagtatgggcctgtgggccgggcgtggtggctcacacctgtaatctcagtactttgggagtctgaggcaggcggatcacaaggtcaggagattgagaccatcctgactaacatggtgaaaccccatctctactaaaaatacaaaaaattagccaggcgcggtggcgggtgcctgtagtcccagctacttgggaggctgaggcaggagaatggcgtgaacccgggaggcggagcttgcagtgagccaagattgcgtcactgcactccagcctgggcgagagagtgagactctgtctttaaaaaaaaaaaaaaaaaaagtattcgcctgtaacaatagctgagtcttggccaatcccagcagctgaacttcaaccactcatagactgttaagtgttcaaaaactgtgttcaaataaggcaaacgctgagctgtaaccattctagctttttctgtacctcactgctgatttctatacatcacttcccttttttcgtctataaatttgttctgaccatgacatatccctggagtctctctgaatctgctgggattctgggggctgcccaactcacgaactgttcattgctcaaactcctttaagtttaatttggctgaagtttttattttaacagggacaaccaacactgcaaagcctgaaacctgtggctcaggcccaggctagactctacttaagaccacaccctggccaggcacagtggctcttgcctgtaatcccagcattttgggaggctgaggtgggtggattatgaggtcaggagttcaagatcagcctgcccaacacagtgaaaccctttctctactaaaaatacaaaaataagccaggcatggtggtgggcgcctgtaatcccagctagtcaggaggctgaggcaggagaatcgcttgaaccgaagaggcggaggttgcagtgtgccaagattgcgccgttgtactccagcctggcaacagagcaagactccatctcagagaaaaaaaaaaaaaaaaaagaaagaaaagaaaaaagaagaccacacccttgcttggccacttccctgccttacatgacttatctccacataggtgacagtgactttggatcagagtgatagtaaccagaagtggtcacgatctggtatattttgtagacctcttaggaaatgtgtacattaagagactgggtctcgtagatctcaggtggaatcttcagcctctgtctagtttttgtgggggtctggccatgcatcacagcctagaaagtgcaggaacctgggctgatttcatggttcagtacatggtttcctgggcaacctttctgccccttgacatacatggataaagtcctgttgccatagtaccctcatatgggtgtatctcatctatgccaactagagaataacctgaggactggagggctttgggtatgatttgtcagaatccaattagcaactccaattgattgatgatggctgattcgtgggtagctatgaatttgcagctcttagctattctgtctgtaaggatgaagacagtctgaaaagtggctgactgctgtatggagtactctttgctcctcctgggtgaaaagggtcgtgacttttagcagctcttcttcttatcttaacattctgaatcccgtgttctaatgcattattgagggtttgtgaagacagagcaggggccagctctgcacccaacgtccctttgctagggtcacgcagaggtaggggcacagtacatagggatgagagtatggggaaaaaagggctgtgacctcagactgcttaggaaagcaaattggcagcaaagttccagctcagccacttaatcttcacgtgtccttgggcaagtcatgtgacctctgttagcgtgttatgatggtgagaatgtgtacactaggggtctcaaacgcagatgcttacctagggccagacagttaatgttatcagtcaaacatggcccattgctggtctgaacaacctgtgccatttctagatggccatgcaggaatgtagatccaatggtgccagattttatcgttttaaagaaaatatggatattttgatttttttttttgtaaaatgggaaatctaattctcatttttggaaaacactacctgaccatgtaaagccacatctgtgactcatgggcaaccagtttgcatctttgatgtttatttttgtatcagaatccgctggtgctggctaggctcggtggctcacgcctgtaatcccagcactttgggaggacgaggtgggtggattacctgaggtcaggagttcaagaccagcctggccaacatggtgaaaacccgtctctactaaaaatatacaaattagctgagggtggtggcaggcacctgtaatcccagctacttcggaggccgagacgggagaatcgcctgaacccaggaggcggaggttgcagtgtgctgagatcaaatcactgcactccccactgggtgacagagcaagactctcgtcccccacaaaaaaggaatctgctggtgctaaccctaagcccccaggggcgtttaccatttcaaggcattctgcctcaatttccacaagtgtcttttggcctgaggtctttctggagcctctggagccccctttgcctacacagatgcttcactggaaatgtgagggaattaaagcaccctttccccagcaaccttcaatgggtaactcaggatttgctttataaataacccagttttccttgcttctcaagtgggataactcatgattaggggttggcaagtgtttacagtaaaggaccagatacagagaatattttaggatttgggtgccatatggtttctgtgataactgctccactacatccttgtagtacaacaatagccatagacaataacatatgggtgtggctgtgttccaataaaactttatttacaaaaatagtcagtgggccaggtctggccagctggccctgtactgggcctatattgcttatctgtgccataaagcaagctctacgcttattgcctgagttctgtgatgaaaataagctgttacccactatggtaactggcttggtaatgggctttctgcatagcctgttttctcctccttgttttacatctcccatccctactgtgttttctaagaaccttctttcataaaagcttcttgcatttaaaacctgttctccaagaacctttttttcatttttttgagggggaaggtagtaggggttagggtctggttcagtcacccaggctggagtgcggtagtgagatcacagttcactgcaatctcaaactcctgggctcaagtgatcctcttgcctgagtctcccaaatagctgggactacagactcactccactctgcccaactaattatttttaaaattttttgcagagacagggtctcactgtattgcccaaggctggtctccagtttctgaatctcaagcaatcctcctgccttggcctccccaagtgctgggattataggtatgagtcaccacatccagcccagaaacctttcaaacgttgttatttggctttatgtttgggagccatttgaatgtgtatttgaatcccagcctgaccagtttcctagccctgttgggttgagcaagtcccttcacctctctcctggcctcaggctcctcatctgtaattgagagaaggtctgtgctttctcagagaatagttaagaggatttaatgggataagatctgttaaactcttagcacataacctggcccatgttcaaggtccaataaatcactggctgtgatttcaactctttatgtgaaggatgcagtttatggctgtcttttaggaattggccaaaatgatgagtcagaagctcttcttattttcctgtttttcaccttgattttggagtaaggtcacccttcccacaggtagggtgtgatttaacagtctttaagagataacattatgaagacacctgggtgcctgagccttttgcatcttaatcgctctccctggtttcctaagagaaggaacagatgggagaatggagactggcttcaactggccgtatttcatccggctgagaacatatgttcttgggaaggatgtaggaacaccctgaaatagagcgaaaaagagatgtgagatgagagaaatcctcctgaaacatgaatggacttgagttcctgttgcccttccttgcagcttgctgcctcctgccttgcgtagaaggaaaactgttcctggttccagacagaatggatttaagttctgttctatcgttatctccttgggaaagctatatgacttctctgagcctcagtttgctgaaatctatttataaacgtttacttaggtggctttcttttttagctattcatctgattacattttctcttgctctttttcattttttggagatggagtcttgctctgtcgctcaagctgcagtgcagtcgtgcaatcttggctcactgcaaagtccacctcatgggttcaagcgtttctcctgcctcagccccccaagtagctgggattacaggctcaacccaccatgcccagctaatttttgtattttttaaatagagacaggctcttatcacgtttgccaggttggtctcaaactcctgacctaaagcagtccagctgccttcacctcccaaaatgttgggattacaagcatcagccaccatggcctggcctacatattctcattttcttctgcggtttgagaaggagtagaaaacaatacaaaatagaaacatgcctttcagccaggcatggtggctcatacctgtaatcccagcactttgggaggctgaggtgagaggatggcttgagctgaggcattcaagaccagcctgggcaatattatgagaccatatctgaaagaaaaacataaaataaaaattttaatttaaaacaaacaaaataaagccaggtaatggaaacaaactctgacatctttctgctacatgtccttttctttctccctttctttttttttttttttttttttttttttttgaggctgagttttactctgttgcccaggctggagtgcagtttatctcggctcactacaacctttgcctccttggttcaagcgattctcctgcctcagcctcccaagtagcttggactagaggcgcccaccaccatgcccagctaatttttgatttttagtagagacagggtttcaccatgttggccagactggtcttgaactgctgacttcaaatgatctgctcgccttggcctcccaaagtgctgggattacaagcgtgagccaccacgcctggcgttgtgtcagtcttatcagaaactccctcctccatcatttgactatgttttgaaatgttcactactccattcaacaaaaaatgcccatacaatccagaagaggaagcgtcttttctgataattttagcctaaatcctagagagatgatttgatttgtgtcatcagtcttctgtccgtctataaaccgattacagtgaccagagggacagcatcctctgactgtcaatgaggaagggagagtgggttataccatcctacgttgtgtggacgagttgggttgctgtagaatgggatagtttgagacagtttctcaaaggaagggattctcgattaagaaaagaaattcgactctatggagtgtgattcgtaaaagggagagtaaggacaaagctattgtcaaggtttctttatcctctgaaatgtaattattgactttttttaaaacatggatagggatatgtaactgatgccttcccccacccccctgaaaagtctaaggtctagaataaaagctacaaaagctaaattccaggatatagaaacaagcctataaaaagcaccttcatcaacaagaaacaggctcaatttcacaaaacaaacccataaagggagaagaaagacatgtaccagttagttttcaatcttcgctcaccttttgttccttcccttcagtgaaacaggccttgctgatgggttttactcattccatggtgtattagctggctaggggcaccataacaaaataccacaggctgggttgcgtaagcaacacagatttgttttcttacccttctggaggctggaaatctaaagccagagcattggcagggtctgtttcttcttgggcctctctccctggtttactgatgacgatcttcggggtgtgtcctcacttggcctttttttttgtgcctacgtgcatcttggatatctctttctctttttctaaaaatggcagtcaaattggattaaatccccaaccttatgacctcctttgaccttaattacctccttctaggtcctacctccacatatagtcacgttaggagttaagacttcaactaggaattttgaagggacacaattcggttctgggaattgttcattttcttctgaattttttttttctgtgtgtgtatgagcagaacatctcttcacccggacagaatgcaattccaagcccctctgttgctgaactgttctccctttaaaactgtcttcatcctcagcgtaggtagctccttccctgagtacgtttttttgttgttgttgttgttgttttttggtacagagtcttgctctgttgcccaggctggagtgcagtggtgtgttctcggctcgctgcaacgtctgcctcctgggttcaagtgattgtcctgcctcagcctcccgagtagctaggattataggcatgcgccactacgcagaggtaatttttttttttttttttttttttaagtagccatggggtttcaccatgttggccaggctggtctcaaactcctgacctcaagtgatccacctgcctcagcctcccaaagcgccgggattacaggcatgagccaccatgtccggccagcacattctttgtctttgcagaaccatgctcccctctgcatctcacagcctcatgtacacacccattgctttatcccatagaatcacagttacttgtgtggatctctgtccctctgtccacccaccacccactacccactacaccagcatgcactgagaacagggtaatgattcagcagtttggtatcctagtgcctggcacagagtagatgtttgataaatgtttgatgacctgaattggattgaagctgaacaaatagaaattgcatttggccattatttccaggcttagaaatgaatgtgtgttaggagacttatttccatagcattaagataatacaatatatatgcaggtgctgtgtgccttatgtagaagctctaaatctctctcaaggatgcagaaagaggtgaggttcaggttgagttgaagaatgaaaaaagagttgcttaggagaacaatgctgggaaagggaggagatttgcggccatgtaatatgggtaggtgaatttcacttaatattgtggcagaatgctctatcacaacagatgctaaaggactacatttccttcctcagctctttcttttttctttctttctctgtttttgtctctctttctctctttctgtttcttttcactctttctttctttctctctttttttttgacataggatcttgctctgtttctcaggctggagtgcagtggcatgatcacagctcattgcagcctcaaacttctaggctccagcgatcctcccacctctgcctctcgagtaggtgggactacaggcacgtatcaccatgcccagcaattttatcttattttttgtagagacagggactccctatgttgcccaggctggtcttaaactcctggactcaacaaatcctccagcatcagcttcccaaagtgttgggattataggtgtgagccaacaggccctgcctaacttttttttcttaaccagttaagaaaaggcatgtgagtgaaagaaacgtaatagagtcacccatcttctgaggggtcagtttcagctgtctgtaggctggatactggagtcattgtcattattgtctgagggtattctggctaactctttctaccaaataaatcaccctagtataatggcttaaaacaataacgtacatttattttacttaagaatctcataatggagtcagctcacttaatcaggagcttttatatagttacatagtggctgagtctggggtggttttttactcataagtctggcctgggaagactcatagagtaggagcaggaatattggggactactaagatctctctttctctccttgtaccttgttctcatctctccatgtggttttttctcatggtgatttcagggtagtcagccttcgtaagtatagtatcacttttgcctcatggattcagtgagtcacacacaaatgtccacccagattcaaggagagactccacacttctctcttttttctctctctcttttgagatggagtctcgctctttcgcccagactggagtgcagtggcataatccaggctcactgcaacctccgcctcctgggttcaagcgattctcctgcctcagcctactgagtagctgggattacaggcatatgcaccaccatgcccagctaatttttgtatatttagtagagatggggtttcaccatgttggtcaggctggtctcgaacacctgatctcttgatgggggcatggcaacattaccaaaaagcatattaacaggaaagataattgtggccactgttgaaaaaagtggtttctcatacgtggttgatcagatacatgtacctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaagggcagttttactcttctctgtgaacatcttagtgtaatattggttttatatgctggtgcattgtattgcccatgtgacagcaatatgagagaaaattaatagtatttttcatcttttgctacaccaccactttatttatttaggtatgtatgtatttatttatttatttatttatttatttttgagagggagtttcactcttgttccccaagctggagtgcagtgccgctatcttggggctcactgcaacctccatttccctggttcaagtgattctcctgcctcagcctcctgagttgctgggattatagatgcatgccaccatgctcagctaaattttgtaattttagtagagatggggtttcaccatgttggtcaggctggtctcaaactcctgtccgcaggtgatccaaccaccttggcctcccgaagtgctgggattacagatgtgagccaccagacccggcctccatcactttttgtaatgagggtgaggacacatttttgattaagtgagttatcttccctttagtgagttaccttccctttgttttgcttatctgagtgagggccacagaggctggagttgtaaatgggacctggacagattgctaagtctgggaaaagatggaatgaggaaggatgagaatggagatgggagtaccacacaggagatcgtgcagagaggcagaggagaaggactttgctttgaagagtcaggcacaaagagctgggtgaagagagtttttagagagtcttgctaaggaatccccattcgtcatctcccacattaattattccccaaagtattttgctgctggagttcttcagtgtcaagactggactcaaggggaatgagcaggctccgctgtcttccagtgaatacttgaatttgtcaagagtaagctacatgctgggctttgtcatcgtcttctcaaagagatggtattgaagattttaatttcagagtaaacctggagtggggaaggagaattgaaacctaagggccagtgggggcagttgtacctcttgcctctggtcaggtgtgggagacagaggagtgagtggttcaaatccacagcccgtcttcccttcttgtgcctgctatttgtggctgatgttgctccagttatctattgcatcatatcaaaggcatttgctctgcttaatgcctttagaaaacaatttaatatcatcttcgatggtcttgtggtttgaccaggcacagatgggtagataccgcttggggtatctcatgtggttgcagacagagagcagctggggctggagctatccaaggatttggatgggctgggtattcaaggtgacttctttcctcatttgtctggcatctgggctagttgtgttaccaggaaggggtccagatccagaccccaagtgagagtttttggatttcacacaagaaagaattcagggcaagtctgcagagtaaagtgaaagcaagtttattaagaaaggaaagaaataaaagaataggcatattccatcggcagagcagcccaagggctgctggttgcccatgttttttggttatttattttatttttttatttttatttttatttatttatttatttatttatttatttttgagatggagtcttgctctgtcacccaggctgcagtgcagtggtgtgatctcggctcactgcaagctccgcctcccgggttcacgccattctcctgcctcagcctcccgagtagctgggactacaggtgcccaccactgcgccaggctaattttttgtatttttagtacagacggggtttcaccatgttagccaggatggtctcgatctcctgacttcgtgatctgcctcccaatgtgctgcgactcacgctcagccggttatttcttcatgatatgctaaacaaggggtggattattcatgcctccgcttgttagaccatatagggtaacttcctgacgttgccatggcatttataaactttcaccgtgctggggggagtgtagcagtggggacgatcagaggtgactctcatcaccatcttggttttggtgggttatggcatctttactgcaacctgttttatcagcaaggtctttatgacccgtatcttgtgccgacatcctgtctcatcttgtgacttagaatgccttaacctcaggggaaagtagcccagcaggtctcagcgtcattttacccagcccctattgaagatggagttgctctggttcaaacatctgtgactgttgggctgggataccttagggaaagccaggcatctctcttttcacacagcctctttgtgtagttagcctggacttcctcctagcgtgacagttgcagattagtcagagcccttaaatggcccctcccttttccatgcaggacatctgtgacctagcccgagaagtcacacagcatcacttccagcatattctcttggttacacaggaccagctcctgcatagggtgggaagggactactcaggggtgagaataccaggaggcatggttcatcgaggggccatctttggagactagctctcatggatgttaaaggcagcggcttgtgagctgcagaaatgggtgaccggattttgcacgttttttgagaagcaaggggaggggaaagttaacttaatatgggagggctgcaaaagttgaggcacagcattttttccagtaagcttggccgtctttgctgagccctgcacgatgcagccgttagcaggctgggcaatgctttgctttatgaggcaattattccaacacactctattcaaaatacacattagaacttaaccttctgaatcctcaagtagcatttttatcacccaccattagaaaagagatggagtcagcatatttccccccctttttatgatcgggtatcattaataaagcattgggcaaggaccttctcgcaattcctcgggataatttgtgacacaaaaggcgttctgtgatacaatggtctgttgacttattcaataacagaggaaacacatggattgttttaaaaaataaagccaaggaattaaacaaccaaacggaatatttcctttcaacaatgggaacgcacgctcagagtagggatgtgatgctattggctatgcataactagaaatgggaagttaatatggaatttctaattggggtcacatgctaatgaactccctcttcatgttagttttatgccgcttcagaaatcttttatcatatgcttaaaaatttatgggcagaaacattaatgaaaatgaggcgtgaattggaaatcgtgtcattatggagatgagggtggcccggcattgctgattttcaaggaggtatcttttattacctttttttgagaactgagaaatgatacaggtaaaattaatgacaaggcgtattctccatcctgacataggcagcatggttctatgtaaagttataaaagtttgattttaataagattttgaattaattataaggagaatattaatcataatggacagtcatttttcagaataaaacttcaccatctaagtaatattatagttcttaagtgcataaagataggcattttcttttttctatcggctttgtcttttcagaaattaaaatccactttttcagactacgatggattggaaagcctgggccttttcatctgtgaaatactcgctcgatttcagattgtacttaaaaagtacctctctttgctaagctcaggggacaggcagattttgtgaggccatgtttatgtggagggagccagtacagtcatattaaactttttctgtttttaatctctcagaaactattgttttcaatacatctgataaccgtcacatttgaatggattttcagaaagtcgttttgtggggtttctaagagttgtacttcacgcttatcacagcagggatgaaggcagaagttggaataaaatcttgtttctaggcctgatctcaagggagtatctttttttattttttattttttaccctctctcattctgtgtgcatttggacccaggtctcagtgagtctgtggcaaagcaggtctccctcaaggctgaacaggcaggcctctgtaacaactgttccagcactgactgagtggttacgttaaatattaaaagctgaggctgggcgtaatggctcacatctgtaatctctaaacttggggaggctgaggtaggcggatcacctgaggtcaggagttcgagaccagcctggccaacatggtgaaaccccgtttctaccaaaagtacaaaaattagccgggtgtgttggcaggcacctgtaattccagctactcgggaggctgaggcaggagaatcgcttgaacctaggaggcggacatgtagtgagctgagattgtgccattgcactctagcctgggcgacaagagcgaaactccatctcataaataaataaattaataaatgccaagaaagccagtgcccttaaacaaaggctgaaatgtaacaaaaaccccccaagagttttgcctaggcctttcctaggccttgaaacatgacaagataataaaggaattcttaacaggacccatttaggattaaacaagtgtattgggggtctgaagaaactccccaggtcttgagaaataagttttttgggtttctaaaggaactccccacacctccatgatttagcaggagacaagagaaggataatcatcccagcacctggacccatttagattaagtaaatttactgaggctgcagaggaaggtcttcaggcctcagatcttatagatgagaagttaatcacttacgtctttagacgaatgcacacttacaggtagacatatagcttagaagctgtataagctctggaaaactttctaattttaagttggtctggtgatatttcccaggccttctccctgtacccggttacaggaataaactcccttgtctcccagttctcgtgtatgttgttattgggccacgagaataagcagcctgaccctcagtttggtctgggaacaactcttcaggagtcacctctttcttgtatctgttcccctgtgcccttcttacctccttccaaactctgcagaggaggcccccgcctgccttttttcctgccttctctccttccttcctctgttctggagacaggacatactcttgcaggaccagcatctcctgtctctgacgggcccactctctgtactgtctctacctgtcaccactgcaagagggtacagaactcagactttgagctcttcaatcatcatatccctgactgtagggattggcccagggttgggtacctgacccaaacaaagtcaaagagattaaatgcctcaggtccgggtgcagtggctcacatctgtaatcccagcactttggaaggccaaggtgggcggatcacttgaggtcaggagaccagcctggccaacgtgatgaaactccatctctactgaaaatacaaaaaaaaaaaaaaaaaaaaattagctgggcatggtggccagcaactatagtccagctactcaggaggctgaggcaggagaatcacttgaatccgggaggcgggagttgcagtgagccgagatcatgccactgcattccagcctgggcaatagagactccatcacacacacccacacagacacacacacgcaaaagaaagaaagaaaaaagaaaagaaagattaaatgcatgggatagtaagctgataggatgtccctgagctgctgatggccattttctcagaacctggggagaccccaccagaggagaggagagctaagcaatgcagacagtcctggccatgcaagtggagcccctgggtccctgcgtccactccagaccgtgttcaaactgtagtaatttcccagcgctgctatagcaaatagccatgaacttggtgacttaaaacaacaaagattgttgcttttgttatcagaaaggggtcccgatcaagatcccaaaggagggttcttggaaattgcagaagaaagaatcagagcgagtccgtaaagtcaaagcaagtttattagacgagcgaagaaacaaacgaatggctactccataggcagagcagctctgagggctgctgattggctactattatggttatttcttgattatatgctaaacaaggggtgaattatgagttttctgggaaaggggtggggacttcctctggaggtgaggttccttcctcacctttagaccatatagggtagcttgtgattgtttcacggcgtttttaaattgtcatggcactagtgagagtgtcctttagcatgctaatgcgttataattaatgtataatgagcagtgagagcaaaccagaagtcactttccttgccatcctggtttgggtgggttttagctggcttcttcaccacatcctgttttatcagcagggtctttatgagctgtgtcttgtgcagaccttctgtctcatcctgtgactaagaatgtctaacctcatgggaatacagctcagtagctctcagcctcattttacccagcccctattcaagatggagttgctgtggttagaaggcctctgacactttcatgattctgaaggtcagaaatccaaaaatcaggctgtatccaggaccatatttcctctgaagtcttgataggagaatccctcctttctacttccaaatgctccttggtttatggcagaatgactccaactctgcttgtttgcacatggccttctttcctaggtgtgtgtcagacctccctctcctttctcttacaaaaagactagtcattggcccaccctaaattcaggacaatctcatcttgagatccttagcttaatgacatctgcaaagatcctacacattcataggtagcaagggttaggacttcgacttatctttttaggagataaattcaacctgctacaacctgtgcaactttttctgttacatatatgacatttcccctgataaagcagcctggtttaatatagccgcagtgtgtccctggcatcctttcttcttacttcagaagctcagaggtcaaaagcaccttaaagttcattcaattcaacctgttaacatgaggcttggagccaggagctcatgcctacctataatcccagggctttgggaggccgaggccggtagattggttgaactcaggagttcaagaccagcctgagcaacacagtgaaagtcagcctctacaaatagtaaaaaattagtcaggagcagtagcatgtgtgtgtagccccagctaccttagaaggctgaggtgaaaagatcacttgagcccaggagatggaggctgcagtgagctgtgatcatgccactgcactccagcctgggcggcagaatgagaccctgtctcatggaaaaagggaaaaaaagaaaagaaagtgagccttgggatggggtgatttgggtgggctggggtggggttgttggatcttgctttgatcgctcagcagtttgcatggcaaaggagaaaaagaatgctgactcccagccaagaatcagctctgtaaaccttggatttgaaacacagtcactgtgtgaactgcccaagtcaaatgctccaggcccaccttccctctcctttactgaggaagtccgagattcacctctgggtgcaggactctttggggttctggctggtagttgccacccaagcctagcactgctattttttttcggagtccgtcatgccataattttctgtaaagaggtagcatcaaaagcagcatttgtgttggcaaaaagctagcccatcttagggtctttcaacagtgacttttttttttgttgctcttgttgttttaaaataagtggggttctcagctttgagataatgggaatgaaatcgaacctctatttttagaattaaaacacacacacacacttgaaataaaaatgtgttgttggacttctaccaaatggttggtgacaacataagttatctcatgctgtctgaaccactggtcagtaatgagatacatgttagaggatctgatttgtttgcaaaggagtgaatgactcacttgcaatgtaaaatgtacattttggctgtgttctgtaggatttcaactataggccatcctagaaaagcaaaactgtggggatagtaaaaagatccaggggtgccagagattatgtgggagggagggatgaagaggcagagcatagaggatttatttatttattttattattattatttttttgagatggagtcttgctctgttgcccaggctggagtgcattggcgcgatctcggctcactgcaagctccacctcccgggttcatgccattctcctgcctcagcctctcgagtagctggggctacaggcgcacaccaccacgcctggctaattttttgtatttttagtagagatgggatttcactgtgttagccaagacggtgtcgatctcctgacatcatgatccacccgcctcggcctcccaaagtgctgggattacaggcgtgagccactgcgcccagccccggatttatttatttacctatttttattttcttttttcaacatgaagtcttgctctgtcacccaggctggagtgcagtggtgcattctcggctcactgcaacctccgcctcccgaatcaagcgattctcctgcctcagcctcccaagtaggtgagattacaggcatgtgccaacatgcctggctaatttttgtattttttagtagagatggggtttcaccttgttggccaggctggtctcgaactgctgatctcaagtgatgcacccccctcgacctcccaaagtggtgggattataggcatgagctgttgtgcctggcagcatagaggatttttagggcagtgaaaatactctatgtgacactgtaatggtggatctgtgtcgttatatattggtctcaacccacacaatatacaacatcaactgtgaactttaatggaaactctgctctttgggtgattgtgatgtgtcagtgtatatggttatcaactgtaacaaattgcacctctggtagggggttttgttaagggtgaagctatgcctgtgtggggccagtgagggtatatggggaatctctttatacttgctgaattttctgtgaacctaatactcctctaaaaaataacgttagtttgaagaaaataaaaatacattttgacaaactcattccttcccaggatttgcaaaagctgatatcacaaagggtgtctctgatgaggtaaggtccggaagcacttgtccctgcaattcctgttggagagcctttaagaacttctcagcagggctgtttgaaaagcttaaagctaagaaaggcctttgtctaaaagagcctggttgaaatccctgctcccagctccttgctgtgtgaccctgggcaagtcactccttaacctcctccctgacttaagccaggctaatccccatctctgcggattaaaggagataacagacgccaggcacttagcagcgagtgtggcctatcctacgtgcttcataaatgatggtggaaatgattatgattgttgctttattatctctaggttctcctccttccctggagtctgggggtggcagtgttatgtagcttcttcctaggtcatgaggtgggtttatctagactctgcctccatggttctcggggccaagggcaactgtactgctgcagattgctgtggtggtagattctgggagaggtgggtggtgtaaatcactaatgaaaaggaaagcattgctttgcactcatttgggtgtaaaaaatggagaattcaggactagaatgaccaaacataaacaaatccaatttcctttttcttttgttgtgtgtgtgtgtgtgtgtgtgtgtgtgtgtgtgtgtgtgtgtgtatgatggagtcttggtctgtttcccaggctgtagtgcagtggcgtgatctcagcttactgcagcctcccgggttcaattgattcttctgcctaaacctccccagtagctgggattacaggcgtgcgccaccatgcctggctaatttttgtatttttagtagaggcagggtttcaccatgttggccaggctggtgtcaaactccggacctcaagtgatctccccaacttggcttcccaaagtgctgagatgacaggcatgagccactgcgcctggctgacaaatccagttttcactgagttctggaaaatgtgagtccagtgactatattatctgaacttaaaaagtagatgtgattggctccaaatgggaatgataataatcatgtttattatcctggggtgctttctccatagcaagtactcacttaggtcctgttcattagtcagtcttttaatctgtactgaaataggtgctgtcgcatccatggggataaggaaactgaggcatggggggattaagttgtttgcccaaggaaatgccgggaaatagtagcagagttggcatttagcatcgggggatccagtgccaggtttttaatggattcacttagggctttggaatggggagtaaatgctcaaaatggagcgtatcatagaaaatcggagatacgttttcttatcttagaaataagaacctggactttgaaggtagtgatttttactctatcacggggttctcaaccatagactgggggcctaaaaagcacataaggcatggttccactaaaaggagacatttacgctcttgccagaggcttcctatctctctgagccagctgccttcccctctctgtcccagcttctcacatagggccacatccagggccaaggagggtaaaatgagcctcccgttgactgggcactcctgcaggcactgaggataaaatgggagtgaagggagagcaagttttggctctcagagcacacacagtctagtttgaaagaaataataagtcatggcaggacagccaggaggaaggggtacatgaccctggggggtcttccagaggtccctgggcgaggtggaggggtgagctcattctgccatccacggagcatgatcacagtagcttattaggtggcgagaggggcggacgggggaagactgagagagatggatcgagttatgcaatgtctttgagaaagaatggaagatacgttagttaaaaataaggccaatggactggagaacatggggtcacagagcaagaggcaaggtggaatgatgttgctgttaggcatgagatagtgcaagctgggctgaagtgaagcgaaattgatctaaattacacctgtgatgagaagtcactgtaactctgcctgcctctatctgtctgtctgtctatctatctatctatctatctatctatctgtctgtctgtctgtctgtctgtctgtctatctatctgtctatctatctatccatccatctatccacacatccatctatccatgtatccatctattcatctctccatccatccatccatccatccatccatccatccatccatccattggcctacctattatctatttgcctatatagacattcatccatcatctacttatacatccctcttttatttctgtatgtacctatctacttatctgtacgtgcatccaccctccatctatccatatatctatacattcatccacccatcattctatttgtctatacactcattcatccattacttatctatttaaacattcatccattcatcatctatccatgtgtttgtacattcacacatccattttctatctatacattgatccatctctccatccatcatccatttgtttatacattcatctaccatctgtctgtctgtacactcatcatttcatcatccattatccatccattatttatgtatggatctgtctatacatccatccatctaccagcagtggggttggctctcatgttccttgagcagggaagagattagagggagctgaagcctcatgggaaggccagttgaagccagttccaaaaagtaatgacatttggagctaggattaggatgggggcagtggataggataggagcagtggatagacgttatttcagaagaaaaacaggaaccctttcatttgctgaatagactgacttgcttatgtgtttctcctacacctctttacatgtcatcagcttctctagttcaccctgcccctcagtactcagtacacttcgctgttgaacagcgaagtgtgtgttcagtaattatattgctcttctaagggcctggttcaagacattgaacacggtaggtccttggtcaaatgggtcttctttaattgtttgtgcccatctgcccgtgcagctgtgggaccctggggaatgtgtgggaggcagcaggtgaccaagccctgaaactaagaatgtaaggggacagggtttagaagcaaccagacatacttcctgaagaattgggttgtcagtctgaaaaaagatgccccaaatcactgctccaattcctcccaccaactgttcagctgccccgggtgccagaaggataaaaacgctcggggagagaggttggcagttctgctgatgacagcgggaaggtgctgcctctgctcttgtaaggaagccatgtgggctcacagtgctgggaggtgcttgggtctgaccctcggatgcatgagagagccactggaatggatctgtggctctgaacttgcaaccccgcacagacaccaccgctagactcggcctcagggtgggaaccccctctccgtgggtgtcctttagctctcttttcagttcagagtgactgacaggcttttctctggttggtgcctttaactcagcaaagacccccaggcaagctgtcacttggagagaggatatttgaaaagcagcctggtgaaattagcagcgatggaaacaatgcaaacatttcatttcttttccttcttttttcttcacttatttttcctccttcatcaggcattttaatactgtctttttttcctggtctcatctcacgcagctgaaataaaagcatgctgcctgacgctatccggaccgaaaaactgaggcttctccctgctttggctgaagttctcccatagccgtttcctgagagcagtcttaaagatttagaagaggaagtctggcagggaaagtctcagaatgatgtgaaggtgtagatgatggattcctcccatcctgtcagtttcagtttgcatttacacaacgtgccaccatcccacaggactcgaggaagcccacaaggtgctggcctcccatcgagtacacatactaactcctgttctcatggcagctggcctcatctccctcctctccctcctctttgcctagtaccttgtaaagtagctgattaccttcattagctcagaatgtattaatccaggtttttttgtttttttttttttaaagaaaacctgcaggtcttctggcagctgaaggctactcttgactcttggctctgtgtcaggattcacataataagctcattagaggaaagttcccagtcccacagtgaccagattagtgggtgctcaggatgtgtactttgagggaaggaagatatctgagcaaagtcagaatgttagaatctcccactttttttctcctgtagttaatacagttcccatccgagaggtgtcaagagcacttacaggagagaccttctcctaatgcattggttaagagtactgcgtgtgaacttattcagtccacttttagctgtctgtccccaaaataggtaacttaacttctcttaactcctcactacattcccagtccttcacctgttatgtgagaatgataatgaagttcttgggaagaccttggagattatggattttaaaaatgcttaggcagttactcaacgaatcctatttagtgcggggtcaggattagggtgcattgagggaggcagtgtcatgcagtgattccatatttaacttaaaaatttggatattttgttcatgatgcatatttcacaatgaataattgtgattttgtacaacattacattcaaataaggtggccgggtgtggtggctcatgcctgtaatcccagcacttcaggaggccaacgtaggtggatcgattgagctcgggagtttgagaccacactgggcaacaaaatgagacctcgtctctacaaaaaataaaaataaaaaaaaaattagttgggcattatggtgcatgcctgtagtctcagctactcgggaggctgaggtgggaggatggcttgagtctgggaggcggaggttgcagtgagctgaaatagtgccacctcactccagcctgggtgacagagccagaccctgtctcaaataaataaaaataaggtaacgtatcttaattgctgagctctctggtgcccccttcagttgtgttgcctcatcctcgttctggccctaattctgagtgtcagccatgtgtgaaccattgtactaattgatgggtatgcaatgttgtgtcacttgagactctttcagtagtctgtcatagatttcccacatacagaaatgtcacacaataaggacacgtgttattttatgtaatataaagtccttacaagcctgggcagcatagcaagaccccatttaaaaaaaattagatgggcatggtggcatacacctgtagttccagctacttgggaggctgaggcaggaagatgatttgagcctaggggttcaagactgaagcgagctatgatggtgtcactgcattccagcctgggcaacagaacaagactctggggggaaaaaaataaaaaagaaagaaacaaaaaaccccaaaatcaaaaacccatgaaaaaccaaaaaaaaagtcttaacagaataagaaggcagggtactttcaatgacccaacaacatcatcacctagactatttctgtcctttcattttctcagtatagtggtttgacacttaggtttgtcttttctcagttgcaagacaggtagtgcagttcccttaatgtttcactgacttagtctgctcaggctgctacatcaagataccttagcctgggtaatgtatcaacaatgggagtacattgctcacagttctggaagctgggcattctaagatcagagacatcagtagattcagtgtccggtgagggctgagtctctgccttataactggtgccctggcgttgtgtcttcacatggtggaagggaaaaagcactccctcctgcctcttttggaagggcactaatcccatttgtgagggctatgacctcatgacgtaatcaccttctaaaaatcctagctcttaatactatcatgttggatattagatttcaccatatgaatttgtggggacatatacattcagaccatagccccctttaacctgaattgggtcttatgccctgtctacaaaggagactggcaaaagtgactacttggaatattcagcatcaatagaagaaagaaggctgtgctagtaagagacaactgcagtaaggctcaaagacctttgtgctgtgctgttccatttgtctgaaacacatgcacacaggtgcacgtgcatacctacccatttcctcctgcccttatttgatcatagaatgtttaacagtttccttcaacagatatttcttgagaaccatactatctaatctgtccaagacataatgatgaaaaggacacatgcgtttcctgattggatggtagttataatctagcggaggaagacagacatttgacaattgagtgggtctactaatacataggaaggaaattattgggaaaaagtatccgctatacagagattttaaaatatagaaagaggtgtgctaaaaggcagctgaattgttatggggatgggattcttctggaacaccttggggattcatatgtaagctgagataggaaagcgaggacatgtcagccacagaaacatccatggaagagcaatccaggcagcaggaacagatgactcagcctaaagtggggagtgtgtttgcttgtttggggagcagaaagggaagggtggtgtaagatgggtttggaggggttggcaggggtcccgcagtgcagagcttttcagattgcaatatgaagagagagagagagagagagttggtgtgtgtgtgtgtgtgtaccactggagaattttgagcaaaagaaatgtgttcccagtttacattattaaaagatcaccagctgttacatggaatatggtgtactgattgggggcggagaatggagtcaaacattccaattaggaagccattgcaatagtcctggatagagatgactgttgttggggttagggtgttgttagcagacctgtgggagtgtggacggattggggacatcgtggagatgtcacttaagtggagtgtccacagtcctgcttctgttgggtgtggagggcgagggaaataggattcaaggctaagagcagagaagtgtctgatggaagagtctaattccctgcagtgatccgctggtaccctttacatcagcagcctcagtggggtggtgagatgggaactggaccgacttgagatgcgggagaatgtgaatgagcatggagtccgtgccacaggcaatccctgcacgcaagttttactgtgaagtgatatagaaagaagaggggaacagagagggtcaaagacttttgtttccttaacaaagagatatattacagcatttttttcccattgtgctaaaaagcacacaacatctaaccatcttaaccatttgtaagaatatagttcagtagtgttcagtatattcacgttgttgtgatagagatcacgaaagctttttcatcctctaaatctgaaactctgtatctattaactctgtaactcccctttctccctctccccagcccctggtaactgtcattctactttttgtctctatgattgggctacgtttgctaccttgtatcggtggaattatacagcgtttctcctttcgtgactggcttatatcacttagcataatgtcctcagggttcatccatggtgtaggatgtttcttcgtttttcaaggctaagtaatattcccttatgtggaatggatacattgtatttatccattcatctgtcagtggacatttgggttgccgccacttgttggtgtctgaatagtgctgctttgaacatggggatacaaatatattgcagcagatttttatactgattggaatgttctgggagaagtggagacattgatgatgcaggagaacaagcagaaaatttcaagagcaaatgctttggggacagacaacctgagtggagggctggccttgatagagatggaggcagaggtggtctcatgcgaaagtataagtgggagactccaggggaaacacaagggaggctgggtagatttgatgtcgagtgggtaagaaaatttctgttcaaattcatatttttttcaataaaaccagagacaaggggccggatgcagtggttcatgcctgttatcacaacactttgggaggctgaagtgggtggatcacttgaggtcaggagttcgaggccaacttggccaacatggtgaaaccccatctcaactaaaaatacaaataaaaatagttagcccagcacggtggtaggcacctgtaatcccagctacttgggaggctgaggaagtagaatcagttgaacctgggaggtggaggctgcagtgagctgagattgcactactgcactccagcctgggtgacggagcaagactccattgtctaaataaattaaaaatttaaaaatagagacaaggccatcagctttgagagagtgtgtgtgtggtggtggggggcggggttggaggatatcaggggttcttccccattaatagcataaatgattaacagtaagtacttggaatcaagttgatgcattttcttatgtgccatgcagacaaaataaagctcagctttgttgtcagacaaaagcagcacttattacaatggttggcatttcagagataattcaactataagagataataacacatcagtcaatcaggaagcattcttcccagtgatatcaacagaattacatgcaagtaatagactgttgtggacccaactaggaattttcttttgctgaaatgctcctatttctaggagaagctcaacgttgatttttcagcttctgtttggagagtctgtttatttctttcttcccgaggggattgtaaatggtgaggactttttattgtttttgacagttatcaaagaaacattttttttaaagctggaccattgactgaaaaataaacccatttgggatttttcgagtaaagtgtgttgaatcatgtttgtgatactcacttttaagttttggcgagcataactgcactgtgttacccattaaccggtagtttttaatttttatttttttaagttccagggtacatgtgcaggatgtgtaggtttgttaaacaggtaaacgtgtgccatggtggtttactgtgcctgtcaagctgtcatcaacgtattaagcccagcatacattagcttttatccctaatgctcgtcccctccatctcccagcagaccccagtgtgtggtgttcccctccctgtgtccatgtgttctcattgttcagctctcacttttaagtaagaacatatagtatttggttttctgttcctgtgttagtttgctgaggataatggcttccagctgcatccatgtccctgcaaaggacatgatctcattcctttttatggctgcatagaattccgtggtgtatatgtaccacatttttttattaatccagtctatcattgctgagcatttgttttgattccatgtctttgcttaatgggggatagttgtaacccctatgaatgcagagaggcatgtggtacagtttgagttggtgtcattttagtaaataacagtccagtttgtggtgatataaatcacatttttttctttttcttttttttttttttttttttttttttgcgatagagtcttgctttgttgcccaggctggagtgcaatggtacaatctcagttcactgcaactttcgcctcccaggttcaaggaattatcctgcctcagcctcccaagtagctgagataacaggtgcgtgccaccacgcccagctaattgttgaatttttagtagagatgaggtttcatcatattggccaggctggtcttgatctcctgacctcaggtgatctgcccacctcggcctcccaaagtgctgggattacaggcgtgagtcactgcacctggcccataaatcatattctttatttgcatttctggaagaccatcaggagggtagtaacatttattaaatgtccctttccatatttttcttatctcttaactgaaactcaccagaggcaggcaccagaaaaccccctgtgtttgcaaaccttgatgaagtttgccagtcactcccttggcttgtagtccttttacttccattttactcgcattcagtgctccctggaaggtgtttctttctgcaaatagctgcgtgagaaatccagcatgtcctggaccctccctcttttaaaacacttttttaaaaggattgttctaaaagaatcttcctctgcttctgcttctaattctggaagaaagggtggagctaggtgtgttcacatggtagtactttttcttttgatccaattgtttaaaaatatatggcagaataaagaggacgggaaaacctcaacaacacctcaggagtcagagagcagaggaaggtgtttcactctgtgcagatcctggactagctctgtgggttcctgtgatggtactgaggtaaagagagtgaagcatctgcccgacgcacagaatttaagaggccaccacaatactcaaccaagaagaaatcatgtcctttttttattatttttttttttgagacagggtctcattctgtcacccaggctggagtgcagtggcacaatatcagctcactgcaatctccgactcctgggttcaagcgattctcctgcctcagcctcccaagtagctggcgttacaggcacataccaccatacccagttaatttctgtattttttagtggagatggggtttcaccatcttggccaagctggtctcaaactcctgacctcaagtgatctgcctaccttggcctcccaaagtgctgggattacaggcgtgagccactgcacctggccgcaagtgcccatatgttgatagcacctgggagaaaattgatcaggtgtgtttttcccacttgacagatgaaaagactgagccacatgatcagaatttcagcccaagttcataaatatcttcccttggaacatcaatttatgattagcactgctcatatgctcataggctgaaagttttctactcctatgacccctaaagtgtacttggtgggtaattaggagcttgctgagtgaataaagataatggtaatggtaataatagtaataaaaataaaactagctgggtatggtggtgcacacctgtaatcgcagcactttgggaggctgaggtaggtggtcacttgaggtcaggagttccagatcatgctggccaacatggtgaaaccccatctgtactaaaaaatacaaaaattagccaggcatggtggtgggcgcctgtaatctcagctatttgagaggctgagggaagtgaattgcttgaacccagtaggtggaggtttcaatgagccaagatcgtcccactgcagttcagcctgggcgacagagtgagactccgtctcaaaaaggaaaaagaaacaaacaaaaaaactagcattaactggtgctttgctatgatttctacaggagttacaagagttcttatatgagcattctaattattacataggggaaactgaggcacggggcagttaagaaactcacctgtactgagaacaagaatttgaacacaggcattctggctttagaggccacactctaaatttctcctctatccttgttctagcattcagtcctatccatgaatacatgaagcaaatatcattttcagaatccagtttccagaggcgagcatgttttatacatctgtggctattggttttgttccaggaaaggggtcctgatttagaacccaagagggggtttttagatctcacaccagaaagaatttggggtgagtccacggtgcaaactaaaaaagcaagtttattaggaaaggcaagtggtgaaagaacagctacttcatagacagagtagggcgttcccgaaagtaagaggaagaacgcatccaccctaggtacaatgtttatatatatatgatatatatatcatatatatcatacctatagcatacatatcatatagcatacatatcatatatatcatgtatcatacatatatatcatgtcatacatatatatcgtatgacatatcaatatattatatatatgatatatgagatataaatgatctagatcatatataatgtacctatcatatgatgtatatcacatatatatcacatatgtcatatccatatcacatatatggtgtatatcatatatatcacatatattgtatattatatatatcatatactatatatcatatatattaaatatcctatatcacatatcatatatatcacatgccatatattgtatatcatatgtatcatgtatcatatatatcatatatatcatatatcatgtatgagatatactttatcatatatgatctatattttatatatatatcatatatatgatctatattatcatatatatgatatatattatatatatcatatatatcatatattatcatatatagatcatatatatcacatatatatgttttatcatatatattatcatataatcatatatgatttaaaaagatcttgggcagatttgctctgctacaagggtttgtgataaaggattaattttcttaattattgtgttttgcaagaattgatattatgatctttgaagcaaaattaggaatgcctttgttctctagataccgggatatctggacactcgcaagtctggttctgtttagcaaacattatttacttgttcccttaaccatacacatctagaggccaggaatgcctgacttcctgagaatgcagcccagcaagtcccagcctcattttccagccctcactcaaaatggagtcactgtagttcgaagacctctgacaattggacacacgtctgtggttcctaactcaggacagatggatttctgtggactccaagcttccaaacggcaggcccccggctggtcatctctttagctctggcactaaccgagtgccaagcacattagcacttggtgaatattgattgaaatgaattgaaattgtgggtggaggaaggctgaataaaggccatttctctgaagaaaagaaagaaaaagaaagtcatcttatcccgtagtcagtgtggattgcaggcacctttggcttatttgcagtatcttgaaaagctgcttcccaatctggtctgagagaaacacgtgagctgaggggactctctagggagatcccaagaggaaactgcctcttccagcctccccagggaaaaaaaaaaaaaaggcaaacctcctttcccaatgtggctgaatgtgtctttgcaagacactcagcattcttgtgtgtttattttctgggtcccccaagccccgccctccctctaacctgccccgtaccccgccccccttcatgtgggtgtcaattacagctgactttgcaggctccagccctgaacacaacagccgggcatgatgccctgggccccatggcatacggcagtggaggtaattagccagccttgactgggccctcggttgcagttcgaaatgcttcttgaaaaacaagtttctagccttggagagcgtggctttgtacttgatagatgttctgaatgtctttattgtggtactatgcaagaaattgggattcttttatcccggtgctctattttgggctggtctttataattagatctaattactcatacagacgtcatgaggacaatgacagctacctcaccgaacacatgatatctggaagaatagttataagcccttggtgcatatttacttattacgttttcattacaggtaggttgtattattatctccattttacagaaagggaagctgaggttcatagaagttaaagtaactcactacagtcatagagcccctttctcctttctatattctgggtattaccaggttgggtgccttccacatattttctcttgtaatcgttttaatgtcctcatgatgattttgttgtccctttcttaccgacttggaagctgaggttttgccaatgtaatcaggatgtgataaatctcagagtaagtttggaagaaggattcgaaccccagatttgaaccccagtggcctgattctggagttcatgctctgtggctacaatacattgcctatatcgggtaacaaatgccttcaatccccttcgcgcagagctgcttcattgcatttttgccctgatgatgctttcggatgctgcagagtgcattggaagggcacagaggcctggggaccacacccatcttggtggagagccccaggctgccacctgtgctaaggcaggcaaactgttgactctttctgacatccagatacaacttctgaggagaggagataatacaaaagttattatgaaagctagagagaatctgtataaaatagcaccaatatgttcaacatgatgattatgggctcagataaaattgtaccaaaaatcagacctgaattcaaatcttagttctagtgttgatagtattcaggaagttgaaaggttatttaaatccccaagtctcagttttcccacctgtaagaggtgaataagagaaaaatacagttaaatagtaaaaaccttagaggattctatggggtcctgtctgattaaacacgcaggatataatagcattcagttgagggtagctattagctatcagtgtaattatgaaaacattagttgaacctgagcactttccattgtgcgatagacccactaaattaaagttgaagaaagtcctttgaacagaagaaattacagtgatttacagcatctgttcttcccccagtacctttctattgattgaagggctgtatgttgtagttaattaaaatgaatatcttcaattggatacagcaatgcttttgcaaaagaagagatagcaggattgcagcacagtacaggggtgtgactctttcattcacagtttggggagctcagaactttcttttgggttgcagaaataagttatgtttcaatagaattcaaataaataaacatgtgaggcgttattatgcttataaatttgaaggctgtgatcattcctcctaaacagtggatgaagattttctaaaaatgcaaaaatcatctcagtgggtattccacccttttctcctgcctacagaaatgccagatgcactcaggctggtgttgggctctgtgatgtgtttgctttgtgagcctcctgggcatctaggtgtggccacaggacaagatcttgtcaaagagatggaactgccagtttctgagaggtctctggggaagctttcattttcctgttggagtgggtaccttctaacaccgtttctccttcccagccttaatggtgtcattatagtgttaacggtggggctacagaactggatatataaccgcatggcaccttgaccctggtgttagagtgtagtagaacagtcacagcacaggctggacgtatgtcacctgagaaccttaatccctcttcaattaagcctccgcagttaggatttctattatttgcatccaaaagcaattctagctgatataacttgaaaaattaccgcaaaattttatttcctatacaaatgtgctgtgtcaggtgtgagtgtgtgcgtttatgatatgaacaatagttcttccgttaaatattacctattcgttttttgttccagatgaggactaacatgtaaccatttcttttgttttctaatcttatctttttccttcatgagagtttacttgccattttcaaacacagaaagatatgtttacaaaagcaaaaaacttgtcttcttatgttgaaatttttctggtgtttgtttgcattcctaggcccactggttatccatgaacagaaaagtgttttccaagctaacatttgacatgagaatcaaaagcgagtattgaaaaacagctttaataaaatggaggtggcaggttttagctgaaaaactccaattatcagaaggtgttggtatttctcaaggaagaacacaatacagctaaatttctgactctcccggagataatttggagggagcaatgtcatcaaaggagggcagattatatgtgggaagaaaatgttcaggaatggagcaggtacagtagctcatgcctgtaatcccagcactttgggaggccaaggcaggcggatcacttcaggtcaggagttcaaaaccagtctggctaacatgttgaaaccccatctgtactaaaaatacaaaaattagctgggcatggtggtgtgtgcttgtaatcccaattaatcgggagtctgaggcatgagaatcccttgaacctgggaagtggaggttgcagtctgccgagatcacgccactgcactccagcctgggtggcagagcaagtctcagtctcaaaaaaaaaaaaaaaaacactaaaaaattcaggagtggtgagatccagtacttttccaattaagtaaactctttttttatttttttaattttaaatttacaggtacacttgcaggtttgttgcacagataagcttgtgtgatgggggtttgtggtacagattatttcatcacccaggtattaagcctagtactcattcattgttttttgtgattctcccctcctcccaccattcaccctccaaaaggcccctgtgttttgtccccctctatgtgtccatgtgttctcattatttagctcctactttacttttctgtttctgtgttaatttgctaaggataatggcctcgaggtccatccatgtccctgcaaaggacatcatcttattcttacttttggatgcatagtattccatggtgtgtataaaccacagattctttatccagtgtattagtctgttctcatgctgctaataaagacgtacctgagactgggtaatttataaaggaagaagattaaattgactgacagttccacgtggctggggaggcctcacagtcatgatgggaggcaaaggaggagagaagtcacatcttacatagtggcaagccagagaatttgtgtagaggaactcccttttataaaaccatcttgtcacatgagagtcagtatcctgagaacagcacatgaaagaccagccctcatgattcaattatttcccgcctggttcccccaggacatgtgggaattgtcagagctaccagtcaagatgagattggggtggggacacagccaagccatatcatccagtctacactgatgacatttaagttgattccacatcttggctattgtgaatagtgctgcagtgagtatacgcatgcatgggtctttgtattacaatagaactttttattggcacatgaaaatacaaataagcctccaaatagtgtgtaatacaatttctttgaaccctcgtgttttaccttacaaatttatgtaaaattttcgtagtttttcatgatatactcatgttggtttatataacaagaatgtggcccccgcaccaatgactaaaccaaattagtgatacgaagagttatccatgtttatggtattggattgtgtattctctggcatccaatttgagaaacctgagaatggtcctgtggttggctatcaggtacccggggagaaatgtagctgctttcaatttgaaaacccttttccaggtaacaaagattgacctacattattccattttgatctttacagaaacccattcccattgttggccagcatgtcattttgacttttgttggttttattagtgagaacactgaatatcattccagagtcagggctctgatcctggagcatcagtcatgtctacttaagtcctttcattgcagcgagctccttctcattcgttcatgagagtcgttgacgaggtggatcctggagtagtctcagacggcctcgccctctgttcatcatccttttgatggaatctccctgttagtagttccaaatcatagttaccatgagttgaacagttgtttgtaccaggagctgagcaaagccctttcttgcacattgtcacattgagtattcacagtaaatgtaagaggtagatttactgttatctcattttgaaagatgtggaactggccaggtgcagtggctcatgcctgtaatcccaacactttgggaggtcgaggcaggtggatcacctgaggtcaggagttcaagaccagcctggccaacatggcggagccctgtctctactaaaaatacaaaaattagctgggcatggtggcggatgcctgtaatccaagatacttgggaggctgaggcagggagaacaacttgaacccaggaggtggaggttgcagtgagataacatcatgccattgtgctccagcctgggtgacaagagtgagactctgtctaaaaaaaaaaaaaaaaaaaaaaaaggaaaggtgtcgaactgaggctcgagcattttggtaagttatctaacatcacattactggggagtggccatgctgagacatgagttacagttttccagataccaaaactcttagctgttccattgacagcttcctagcagggatagcacaccaagcctctaccctttccttgggtagtactcatcctctgactctgtcacccgctttatcctcttggtgatggcagagctacttggaatcactagtaactgcattagaatgatgtgcagttgtctatccaatgagttttgtccattatttctttagccgtaaataaatgaggaaagtacagaattattggtggggggtggtctttgaaaaagctagggtgggagaatatcgagaatgatataattatctatttgctgcttctggtccgccgacttgctggctttttttttttttaataggattatggaagatgaaaaggaagcgcttacttcagcttataagagcaatgtaagcaattttgcattgcactcactccccaggggtggtgtgaacatgtttctagtaaattaaagtatcataaaagcattggcaacatggcaacttttatattaatttcttaatttttcgcaggcttaattataaatctcttgggagaagaggcaaggcctgtcggttcctgggaaaacagtgttgcatctctaggcttgaaggtctgctcttctgctcagaagtatgtgtgctgtgatgtaggctgggtggctgctgtaggttgcatgcactacttgtgcctagtgatggtagtgatgccctgtggacaagacattaggctgggaggcccatgcatgcagccaagtggagagagtgctcttggacaaggtgttgtgtgactcttagcatgtagtaatgtgtcataagagcacagtctctgcagtttactaagtgtaaaatcctggatctggcctggagtggtggctgaaccctgtaattccagcactttgggaggccaaggtgggcagatcacctgaggtcaggagttcaagacctgtctgatcaacatggagaaaccctgtctctactaaaaatacgaaattagccgagtatgatggcaggcgcttgtaatctcagcaacttgggaggctgaggcaggacaattgcttgaaccctggaggcagaggttgcggtgagccgagatagtgccattgcactccagcctacgcaacaagagtaaaactccatcttaaacataaaataaaataatcctggatcctcctgtactacctgtgtgacctagagaaatttgaccagccctttgatctgtgaaatatgatggtatcaatgtcacctgggatatgcatgaaaaagcctacatcctacagcactactgagcatcctcaccagcctaggggtatctccagtgagacgaaccatcaggaaaacaatatatatccctatggatgaagccactgttaggcaggttttgttacttgcagcctaaagtctcctcacctttagtagtcactaaattagaatggtgcagcagcccattgagttccggattcactgaatgatggcatatttatgctggacagaatcttagctctgcccagtgagtttaccacatgccttctttacttaatatttttattattattttgagatggagtctctgttgaccaggctggagtgcagtggtgtgatctcttctcactgcaacctctgcctcccaggttcatgaaattctcctgcctcagcctcctgagtagctaagattagaggtgcatgccaccacacctggctaatttttgtatttttagcagagatggggtttcaccatattggtcaggctggtcttgaactcctgacctcagctgatccacctgcctcagcctcccaaagtgctaggattacaggtatgagacattgcacccggtaccttctttacttacaaatctactgtaaggaaagtgaaaaatcaggagggagggctccttgaaaaacccagggggaaatatcctggctttgctggccagatcccaatgagttagttcctctggatttcatttctcaagattctggaatttcctctcccctctccttccttcccctaccctaccctaccctaccctaccctcttctttcctctgcccttctgtagcatagtatggtttaaaatgtgatcacattctattttaatcatggaaagatttttttctctggcctcttgtcttttctgggctacatgccacatattggtagggaatatatcttatgtttttacatgtccttcaattaattttgaaatattaattttatgataggttaacttatgctgcacacacatacatacacaaaagatatatggtcttataaataggtatggctggacaaggtgactcaggaggcttaggcaggaagatcacttcagcccatgtgttctcagtctagcctgggcaaaatagctagtccacatctcttaaaaaattaattaactaaagaacactatgtgtggaaaatactggattagaaagattagacagggctgggagcagtggctcacgcctgtaatcccagcactttgggaggccaaggtgggtggatcatttgaggtcaggagttagagaacagtctgaccagcgtggcaaaaccccatctctacaaaaaatacaaaaaagaaaattagccaggcatggtgtcaggtgcctataatctcagctactcaagaggctgaggcataagaattgcttgaacccaggaggcagaggttgcaatgagcttagttggtgctactgcactccggcctgggccacagagcgtgagttcatgtaaaaaaaaaaaaaaacagaatttttttttcttttttctttttcttttctttttttgcaggacttctttgtatctttaatctgcaaatgaatgtgaattgtaaatctccatggagtgatatagaataaggcactttccaaacttaccggacgagagaaattttttttcataaaacatcttgcagaaactcactttagagaacctgcatatctccaatttttaaatttcatttgtctttttaaaaatgtgcaatattttttcaactttttattttgaaaaattctaaacatgaaaaaatgtaagacttgtacaataacccttatatacgtctaccagaatcaccaatttctatttttatttatttatttatttatttatttattttctgagacagagtcttggtctgtcacccaggctggagtgcaatggcatgatcttggctcactgcaacctgtgcctcccgggttcaagcgactcttgcctcagcctcccgagtagctgggattgcaggcgtctgccaccatgtctggctaattttcctgtttctagtagagacggggtttcaccatgttggccaggctggtctggaactcctgacctcaagtgatccccctgcctcagcctcccaaagtgctggtattacaggcgtgagccaccacgtccagccccaggctggttttgaactcatgggctcaactgattcacctgccttggcttcccaaagtgctgggattgtaggcatgagctcctgggcctggcccagaatcaccagtttttaatattaaatattttttactgcatttgctcatcctctgtctccctcttttccttcccttcctctccctccccttctctctctccttctctctgtctttttgcaaattcttgatgggtatcttttcgtgacaagaaagaaggtggtctggatgccagttgcctcctccacttgcctttaagaaaataactgaacacgctgtagggcaggtgcctgtatgtttcacttgtcttggttgatgatttattataatcccatcttagaatcctagaatctcaagttgcagagggacctgaaaggttatctaatccaccccttgctcacctgcccaccccgcctgcattccctacccatgctttcgaatgccatttattgtgtttgccagggtttgttggttagtccattctgagtggaatgaaacttgcaaataaggccttgtggagagcctgccctcttcctgggcatcatccaagcgatctattagcagcttccatttatcagcgtcttgtgtgggtgtagtgggcctaataatgggagctcagtcagagagcagcattttgatagaggactgaagtgttttgccaagtcttgattacccataataacaagaatgaaaactttggccctggttatgcacagatttattgaatcatggaatattcatgctggatggaatcttaggatcatctggttcagtccctgaagttttcaaaggaggaagtgagtggagaacaagagagaatgagtagtttgcctaaaatctcatcactaccatggtttctgattccaggcccaggttatctcccgagccactaggcttatctcaggacagcaacagaaaacttttcagacacacacacacacacacacacacacacacacacacacacacacacacagaggcatgccccacacattgcaaacataatcatatacacgggcacatctatacataagcataggtgggcacaggtgcacaaacttacctgcaatctcattcataaatggaatttccattccgttgaaatatagctcatgactggggcctccactgacctgcagttcacaatctagaagtgtgaacttggaaatagaaactcatccaaatacatgaccacagtttattcacctgtgtggtgcctcttgcagatagcagaggggaggagaataagaacgaacattgtaaggctgttgggatgactggtccgtggagtgacagaagagattagaaatccaggtttattgggagggcatctcaaagcagccacattttatccctattcgggtcagaaatgaaatgtttatgatggctggaatgagatcccacaggaaacttgagtttactaagtgccagctaggcagtctttccttgcataatcttatatagtcgtcatcatggttatgtttctggtgaaaaaaaaattagatatggaaatgctattagttaccccacattccacagccagtaaatggtaaaaccaagaatcaaatgtggatccagagagcactgagaacataggaatacataaaaaagaaaacgcatttcaaagagaaacacagcagagttttagaagtgtcctaatggtaaatctccccctaaatttttggaaacaaatttgcattttcctgctggtttttccaggcaggactttctcctctcagcaaagccctatagacctttagagcagtgtagtctattggagtttcctgtgatgatgaaagtgtttataatcttactgtccactgtagtagctactgtttacttatggttattgagtgagttaagatatatgctggatttcaaagacttagtatatgaaagtgttttaaatagctcattgagagtttttaaaaagtcgattgcctgttgtgataacatattgggctaaatatatttttaaaattagtcttacctgttttattttttcttttccctttttattttaatttaactttatttaattttattttattttatttatttgggaccgagtcttgctctgtcccctaggctggagtgcagtggtgcgatctcggctcactacaacctctgcctcagcctcagcctcagccttagcctcctgagcagctgggattacaggtgtgtgacatcacacccagctaatttttttttttgtttgtttgttttttgttttttgttttttgttttttgtttttgtttttaagatggagtcttgctcattgcccaggctggagtgcaatggcataatctcggctcactgcatcctctccctcctgggttcagtgattctccctgccttagcctcctaagtagctgggattacaggcgcccactaccatgcctggctaatttttagttgagatgggttttcccatgttggctaggctgctcttgaactcctggcctgaggtgatccacccccctcggactcccaaagtgctgggattataagcgtgagccaccgcgcccggcttttttggtatttttagtagagacgggatttcgccatgttgggcaggttggcctaaactcttgacctcaagtgatctgcccgcctcagccttccatagtgctgggatttcaggcctgagccactgtgcttggcctctttttccgttttaaaatgtggctattagaaaaattttaattgcatgtattgcttgcattatttttctcttgggcagtatggatctggataatttgtctatgaagatatatttacaattatatgtgcttctctctgtctatctgtatcagtctgtcttttgaaggacattttattaaacagcattatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaattccatctctactaaaaatacaaacattagccaggcctggtgatgggcaccgtataatcccagctactcgggagtctgagacgggagaattgcttgaattcaggaggcagaagttgcagtgaactgagaccgcaccaccgcactccagcctgggtgacaagagcgagactctgtttcacacaaaaaactgagaaaatgtctgcaaactacttgaaatatgatttagctcccctgtactagaatatactcttcaagaggtcagatactgcttgtttttatgtgaacatatgtcaccaacaactagtaaacgtgcccaacacacagtagggattcagtaagtatgtgttgaagaaatgaatggaatggcaactctcaattttggatttctttgcttcgcattttaaaaattctgatagtggccagatagcggtagctcacggctgtaatcccagtactttgggaggccgaggcgggtgggtcacctgaggtcaggagttcgagaccagcctggccaacatggtgaaaccccatttctactaaaaatacaaaagttagccggtagtggtggcgcatgcctgtaatcccagctattcaggagtcggaggcaggagaatcgcttgaacctgggagttggagtttgcagtgagttgagatctcgccactgcattcccacctgggcaacaagaaagaaactccatctcaaaaaaataaaaattctgttagtattcacatagaaggatgatactgtgtcccataaaatatatccaagtttaccaagtagaagtagcatatattacattggtgcaaaagtaattgtgctttttgtcattactttcaaaggcaaaagccgtgatcagttttgcaccgacctaatagttgtgaatgtgagcttggacaagtttcttaagcttactggtcttccatgatcttccatgtccatctcaggatagttcgagcccaaactgcttgttaaggtccaggaagctgatacatatcagtgagtgctgataacagaaaaccatgctatgtctagttgctaattttttaagataagataaggctgtcattttttatgatagaaaagtgactctcgcaatttattgccaatgagaaccaccacattgttcattgattgcatattttaaagctctgtgtccagatattctaatttactacatcacagttggctatttctggccaggcgtggtggctcacacctgtaattccagtacgttgggaggccaaggtgggtggcctgcttcagcacagaagttcgaggccatcctaggcaacgtaataaaattgtctctccaaaaaaaaaaaaaaaaaaaaaaaaaagacacggtggcgtgtacctttagttccagttacagaatgaggcaggagaattacttgagcctgggaggcagaggttgcagtgagttgagaccatgccacgtcactccagcctgggcagtagagtgagaccttgtctcaaaacaaaagttggctatttctgcatttctccatttcagctaatacatctgtatgtacaggccctggacaggatgcctgggagacattaataagcaacattccgtttgggcctcaggaagctcatatcccataggggaactgacacaatgattagcacaaatacgtagataagtccttttgaaaaatgaattcccatgtgattattatcatcaacccacttctcaaatgttttttctttttgttgttgttgttttgagatggggtcccactctgtcacccaggctggagttcagtggtgcaatctcagctcactgcaacttccacctcccaggctcaagccatcctcctacctcagctgtccaagtagctgggaccacaggcttgtgctgccattcctgcctgacttttgtagttttggtagaggtggggtttcaccatgttgcccaggctggtcttgaactcctgagcccaagcaatctgcctgcttaggccttccaaagtgctgctaggattacaggtgtgacccaccaggcccagcccacttctgaaatgttaatgtgcataggaatcacttcagggttttgtatcaaattcagtttcttagatcctacccacagagtttctgattcaatcaatagggtggtgggggtgtcccagatcctgtgttgttaacaggactccctgtgtttcagaagctggtgctatgaaaactacaccttgaaaactattgtcagagtgtggtccacctctagaaaatattggcctgtctttgccagagtttcacccattccttagggagaacgggtgtagctgtctcttcctttccagtctgtgtaggaagcagaaccaagctcatagagaagcaattttttgttttttttgagatggagtctcactctgttgcacaggctggagtgcagtggtgcaatctcggcttactgcagcctctgcctcccggattcaagggattttcctggtgcaatctcggctcattgcagcctctgcctcccaggttcaagcaattctcctgcctcagctttcccagtagctgggactacaggtacccaccaccatgcccagctaatttttgtatttttagtagagacggggtttcaccatgttggccaggctggtcttgaactcttgatctcacgtgatctgccttggcctcccaaagtgctgggattacaggcgtgagctactgcatccagcctagcaattccttaagtaccttgttcatcccttccaaggtcagcttgggttcctcagtagtcgtggtatttctctgtggtgtaaaatgcacataaaggacttaaaaactaggtaagaaggcagttaaggataaaagttacacaacttcaaccatattctgttagagccacaaagggcttcagaaaccagctaatgattttagagaaaagatggcatgagtccaagaggtcacatgatctacccaaggtcacttgtgtctagagtttttgtgtatcatgacatgaccaatggccatggcccagaaaggctgattccttccttttccaaaaaaaaaaaaaaaaagatttgtgatacttcaatatattcagtgcccaccgcccaagcacggtgtcattcacaaggaattataatggatttcattgtagaatgcagactccttcttcccaattacttctttgctttaaacataaagccgagagcctgaccctgggaatagttcttgtctgaatttctgatagattttaatttcgcagctggagcctggtcctcacagtcattccctaatttcttttgttagtctactgcattcatctttggttctgtgtaggatccatagatggactgaactgtaacactgactttcttttctttgtctcacttgtcaaataaaatcatttgaggctgaatggtattgatagctgtgcaatgacttgttgctactgtagaggggaccctgcacacaccttcctgggagtcatgtttgttgttcaaatgagtcttctgagaatcaggatctcttgaaaaagataacacatcagtagtattaaaaactaacgaatagggcaaatcctcatttagctcctttcggtaataaattcatttgcttgggttcaggatttgtagagcatattctaaatgcattgctggctgagggatccatcagagtgggaaggggagatggggaaagccatcctgttgcattgaagaaacggaatctgtgatcaggaaacctggttaaaggtcctttcccctttgtaattttattctacatagggaggcaagagtggtgctgcaacatatggagagacttgagtttaattgttaaaattccactcagccgggccacttcttcactgtgatttgcactatttagcatttgtgtgcattaggtaatatatttaatgtttctccctccaatccaatttgcgtgtgtttggcagcagcccagctccatgggcatggggcaggggagatcataaatctgccatcctggagcatggaaactgtattgctgcatttgatagtatgcttgcatgaacactccaaaatgcttgtgaagcaataccacctcttccccgaacgtctctcagggacaacattaatgtatctcatattgtattgattgtagccaataagtgcctaaatgatttggtgcaaggcagaaagattatgcagggaagaggggtggaggtggctttagaagaagtatgtggtttaattactggctgaatttcctcaatccacctccccctctgggagtttaacaaacaggccttagtgcactttagctgttgctgacatctgttgaaatgatatctgcccgtgatgaggggagtttgggaattgcgcttggggtattggcgggatcagggagccacaggaagctcctttccagtctgcaaaattagaaggaggaaaacactgcagtagtactctaaggttaagctatggagagcacagttttatctaatggaattctgccttccgacttaatgaagccatcttcatcttaaatgcagggttggatgtaagtgtctagagtctaatgatcttaaagtcccaggtgttgataacaaacacagagttgagctgaaaacatgaatagtgcatgggcaatgcttcaggcacccaattgtaaaaaccacccccagctctctctttttaatgccatgctaagaactgttaggaaacttcacagtttttaggtaaacaacaagtgaccgattttcttgcattttttaatagaagcaaaagaagccaaaacctagctaaaatttcatgttgggtccagcaccaggaagaatgatgctgtgtatctgctagtgttttgattacatcaataattcaaagaaagtgccatccacttaatctcttttatgcctctccacccgaaaggatcctggttgtattctgaaagtcctgaagctatcatattccacagctttttctgaaatgtgttattatgttatgcttgaaacatttatatatgttaccgaccaaattgcatggaaacgatttgctttcagagactgataaaaattcacttttgatggtagacacaaggtgagatgttatcaaaacaaaattccaaattaacttggatatctctatcagaacatatccctgattgggcatgtgattcttgcattattttgtgtgtgtgtgtgtgtgtgtgtgtgtgttggtcattgtatttaaaaatgtgtttgcatacgtgtgtatatggatatatatgtgccaggtattaggctggctaattattgtgactaaaactctctggggttaagtggaaaattaaaaattcagaacaaccatagtctgttatctgtcacctgtaatttaggctaatatctcaattctcttgttatggacatttctcttacagtgtggctttacataatgggaattggatgtaatgtgatcaattaattagagcatatgatttacattagtcaaacctgtattgattacaaaatgactatgatctgaaagtagccttgtgtgtgtgtgtgtgtgtgtgtgtgtgtgtgtgtgtgtgttagaagtggtgatcctgctttgtatgtggccaacttggggagggggatggatttttcactttattattgtgacgtgtgatagacctatggggtgttttaaaattcccaagcaaataatcttgctggtggtgacagaagaggaaggctttgaagaggggtgtggtggctcacgcatgtaatcccactactttgggaggccaaggagggtggatcaccttaggtcaggatcaccagcatgggcaacacactgaaaccttgtctctactaaacatacaaaaattagctggacgtggtggtgcacgcttgtaatcccagctactcagaaggctgaggcaggagaatcacttgaacctgggagcacagaggttgcagtgagccaagatcatgccaccgcactgcagcctgggccatagagtgagactccatcttaaaaaaataataataaaaaacaaaaaaagggaaaggctttgaggtaaaagctagaggtacttacacttgagattggttcagattttataactcaacagacaagtatctgattctctgcatcctcctatgtttgaaccataaatttattagaaagcatatataggaaaaaacaacccagttcctttgagtctgaaactttctagtccctaattactttttcccattggaagtatatttatagcatacaaatctaaacttctcaacttaccttgataactggtccccatgttgatggccatggggcgtcttgaagaccatcagtgatccaagtatattccattagttttcatgtcaagaacattttattgtatcctaattatctgaaacttggtcatctgaaataacatggcagttcccgataaatcattgcctttttgatttcctagccatcttgaatacaggaaggcttagtttagcctttgcttttaaattcatataaatacaatgatattgagtatctctactttagaataacactgaactagtactgggatttttaaatttgatattcggacagctctttttctgttctgtggttttgtgcatgtgtgtgtgtgcatataaacatgtatgtgtgtgcatgtataggtatctggatacacatctagatgtgtttatatctagattgatacatacatgtgtatatatatccatcctcctatctggacacgcatatttgttacttgaaaataagtagggcttgcatacattgtagttactattgtaagtgctttccaaatatttaactcatttactagcccaacgactttatgctttaggcactgtattttcatttaaccaatggggacagtgacgcacaaagaagctaattagtttgtctgaggtcacagaggtagtaagtggcaggattgggattcaattgataatgcagtgcttcatacaaataatgctttgcaatttttgagcacttttctacatgtcagatagagggatttaattttttactcatttgatttttatggccagtctatgagttgatttccatcattgctagtttgctgaatgggacacagaggctgaaagaataacacatctgtagtcacagagttagaagctgatggaactgaactttgcatccaggaaatcagactagagaatttttaataaattatcaagaaagtttataggcagcattgaagatttcctcatcagctttatacatatgtatatgtatatatgtttatatttatatgcacgtatttataagtacattgtagacagatgaaaaataataaaagcaggaagtaccttttgttgtgttgactgtgttttgcccccaaacttacaactctcaatagttgtcttttctgttagctgaaattaaatagagaattatcttagcattttcccccaataactttaaggtttcttaagagatggtaagtccctttgaagactagagtgatttgactcaacttctccttctagtaaaaaaaagtctgccaccaatacatgtttatatttgttaaaataacatacttatcagtatgaagtggcatcagcaaaaccaatgacttaaaggtacaattgtcaacctatgttgaaaatatgttgaatttccaagagggaaacggctgcttgatcagagttcatttatatccacgagcattgcaccagcaataaactttaagttaatgttaacaattttaatttgtatcttttaattgttgaagtctgaattgctttccaatttcccacagagtttaatgtgtatgcaaattgcacagccagaaatttaagatacaaaagatagactgcgttttgcaaacataccataattattgcttaatttttaaagggtctttctctttgtcagggtattgttcggtttcttgaaactgaacagaagaaaacttttggttaatgattagtataaatcttgtaatggaacttaattgaatattaactttgttgttctcacaactacagactactcaattccctgtttctctgaggtagggtttcttgctctgttagtgcaaataatttgtcttctagtaatagcaggaaacagttatcagaacaccagtttaattgtctgaaggttgtgcactacatgtaagctcttagaaaaaggttaaaagaattctcatgtctattttaatattatatttcgtaatcatttaaacagcttggcagtcctagcaaagtaaaaaaaaactaaaattgaaggtaaatgccgttcttttgttaaaattcaaggtaggaaatgctgagatttagaaaaaatatagatataaatatatgtacattatatttagtgtacaatagcatatgtagtatataattatctatttatttatttacttattgagtgtaaaatgaaagcagccaaagcagtacatttggtggattagtagtgatttagctatgaagcatttatatattcaaatatttgttgctaaatattcctaaagcctatggggttctagaaactggcttaggagaggagactgaaggatgaacaacactcattagtgtcttccattgtgttcaagtgtttacacatgaatccaagaaataataagatgctacagatggtgaaaactaatctgaagggggcaaaatgaagccagtgagacacagaatggtttggggatgggggcagttgtgttagacaaggttttagggaaaagatgatgtcagagctcttggcaatgacttggccctaccagaagcaagagacaaagttctaaatgagaacagctggttgtattgaagaaccaaaataggattttaatttggttatatcattgtgatcgatgacttttgttgctttttggtgtctccaaattgcaatcctgtttcacattttgtgttcctttccctcagactattccaagaatgaaggatgtttgatgatggctacaggttgtcttgtacagaaaacttaatatatcaggctctcttgagagagtaggaagggcattttattacagactccagtctaaaattccttctgagtactttaaaatatacccacaaatactggagtcatgtttcttctttttttaattaattaagtattattattattattattttgcgactgagtttcactctatcacccaggctggagtgcagtggcacgatctaggctcactgtaacctccgcctcccaggttcaagcgattctcgtgcctcggcatcctgagtagctggaattacaagcatccactaccatgcctggctaatttttgtattattagtagagacagggtttcaccatgttggccaagttggtcttgaactcctgacttcaggtgatccgcccgcctctgcctcccaaagtacagggattacaggtgtgagccactgagcctggcctttttattttattttattttattttattttattttttatttttatttattttttttatttatttttttttttagagatcaggtctcacttgttgatcaggctggtcctgaactcctgggttcaagcggtccacctgcctcggcctccaaaagtgatgggatgacaggcatgagccgttgtgcctggccaggagctacatttttactccagattcattggtggaccagagtgatttggtgatacttaaactcattctgattttttttaatttttattttttatttgagacggagtcttgctctgtcacccaggctggagcattctcagttgtttaatggtggttttaaaatgttttattatgaaaaatttcaaaaaaacacaaaagtagaatagtatactgatccctcatatgctttacagcagatttcaacaactaccaatatgtggccaaacttgttttgtgctttaatcttcttctcccttccccatcaatattttgaagcaaatccaaaatatactattattattaaatatatcagtatgtatattggaaaaaatgaaactttttaaaaaaagaactgtattgtcattaatgttattatgcctttaaaattagcaataggccaggcatgttggctcatgcctgtaatcccagtattttgggaggctgaggtgagcggatcacttgaggtcaggagtttgagagcagcctgagcaacatggtgaaaccctgtctttactaaaaatacagaagttaaccaggtgtggtggcacacacttgtaatttcagctactccagaggctgaggcaggagaattgcttggacctagcaggcagaggttgcagtgagccaagatcacaccactgcactccagcctgggcaacagggagactctgtttcaaagaaaaaaaaaaaaaaagattatttaagtaggtgtccaaacatcatattatttttaaagttttcagtacttacaattagaatatgagaattcttaaggaaaaaaaaagtactgtcattagcgttattatgccttgaaagtagcaataatctgttaatataagcaagcattctatcattgttcaagtctacctgataatcttacacatttttaaagttttattatcagaaatttaaacatgatcgatatgtctcaaattaaaattagtcgatacatctctcaagtttcttttattaaactggtaccacctccaactcagtgtttgcaatctatttgttgaggtcaccgggtcatttttatgcaacagtctctacatagtctggttttgctaattgcattctttcttctttatattttctgttgactggtggttaaattcagaagtttgatgagatttttgttcaattttgcttttggcaaaaacacataataagttttcttttctttttttctttctttttctttctttttttttttttttttttttgagacagagtctcgctctcctctgtcgcccaggctggagtgcagtggcatgatctcggctcactgcaacctctgcctaccgggttcatgccattctcctgcctcagcctcccaagtagctgggactacaggtgtccgccatcatgcctggctaactttctatatttttagtagagacggtttcactgtgttagccaggatgctctcgatctcctgaccttgtgatccgcccgcctcggcctcccaaagtgctgggattacaggcgtgagccaccgcacctgggaaacacataataaattttcttgtttacttccattaggaaccacataatgcttttctttattgaagtcctttttggaaatttttatcagtcactagcaaccattaccatcactcctttttcatttattagatagaatacttgtacagagaaaaatcttttactgattctttgcttaccccaaggtagagttcatgtgagaaaaataggggcatctgtatcttccttcatttttttccagttttcaaatccgtttgagttagtttgcttgcatattccaaaggagactaatgatcattctaaatgtccattctgaagctctgttgttggccagtgggaatgtctttctgctgtctccttgttcagatggatggagagattccttgctttgtgaggtgacaaggtgttcctggtcaacttatgtatttcctaccctggccctgactctgtgtgtgtgtgtttgtgtgtatgtgtatgtgtatgtgtatgtgtatgtgtatttgtatatgtatatgtatatgtatatgtatatgtatatgtatatgtatatgtatatgtatacgtgtatgtatattttgagatggagtctcgctttgttgccgaggatggagtacagttgcatgatctcaactcgttgcaacctccgcctcccgggttcaagtgatgctcctacatcagcctcccgagtagctgggattacaggcacgtgccatcacaccctgctaatttttgtatttttagtagagacagggtttcaccatgttggccagggtggtctcaaactcctgacctgaagtgatccatcctccttggcctcccacggtgctgggatcacagggatgcgtcaacacactggcctctattatttgtttttagaagcttttcagaaccaggaggcagctcaatttgggagattttgtgaacatctttattattattactttaactctgttcagcacttgtctcaacttttcttattaagtggggagtccccatagtaagcgggggtccccaaaatagaagatcagttctactttttttctcctggagtttcttcttgtgcacacgattgagcacgtgagtgaactcctggtgtttagagtgacagtatccctgggcatagttgattcagggatgggcatgtgatcaggtggaccaccgagagattcctgggggactttgctcttagacgctatggagaaatttttttttctcatggggttgttgatcttgttaggtgagtctagggttattgtggccatccacctctcagtgtactgacatgcaatctaagaaattaggaaagggaaaaatcttgatgctgtcacttgaggccctggatacagcggtgcatgaagttaatctatctactttggaactttgcaagcatgtgagccagtgcattttcttgtatcctctaaagctattttgtgtttgtgtgagcacatgtgtttacacatgaaattgccctgatatgaaggttttctgtttatccagcaagaaagagatttaaaaaagatcttttcaactattttcgctgggcgcgatggctcatgtctgtaattccagcacttgggaagctgaggcaggcggatcatgaggtcaggagttggagaccagcctggccaaaatggtgaaaccccgtctctactaaaaatacaaaaatttgctgggcgtggtggcatgcacatgtcatcccagccactcgggaggctgaggcaggagaatcgcttgaacctgggaggcagaggttgcagggagccgagattgcgccactgcactccagcctggtgatagagtgagggtccaactcaaaaacaaagaaacaaacaaaaaactattttcaaatagcactaagtggcttaaaatacacttcctgaatgtcggctttgtttgaggaatgtgttgtggtagatgctatataataaagggaaattaggctgataggagtttctctcaacatcccgatacactcagcgtgttaagataaggctagaaatcagaataacacaagacagaaacttaggaagttagaaagtgtaagaatgtaggaaaggcgatgaggtcaacattttattacagttattttctccaaactatgagtggatcttggtggtctttttttttcttcttcttttttctctgttgtgtttggtttcccaaagagaggttatacaatcaggccatgatttacaaagaatagtcttgcaggagcattgcgtaaaatgggtttaaagaagaatgaaagatgctagacagatcgtttaaaaaggagtttctgggccaggcacggtggctcacgcctgtaatcccagcactttgggaggccgaggtgggtggatcacaaggtcagcagatcaagaccatcctggccaacatggtgaaacccccgtctctactaaaagtgcaaaaattagctgggcgtgatggtgagcacttgtagtcccagctactcaggaggctgaggcaagagaatcacttagacctgggaggcggaggttgcactgagcagagattgcgccactgtactgcagcctggtgacagagcgagactccatcttaaaaaaaaaaaaagaaaaaattataaaagaaggagtagtttgtgaagccctgttaaatcctgctctcagggatgcatatttacaccctttaaaaataaaataaaaccagaggttgaaacaaggtattaaaatacctctggagaaaaactaacctcttccaggaaagttttgttagctataaactcaaaggttgatacatgtagcatcaaaggaacataggaaagcttagttgatgctgtaattattaaacacaaacaatgtaattaagttagtatgtattagaaaaaaacatgatatgcacatcaagtctaattttattaatagaactttttgggatgagactaaaggacaattccttgtccaggttctacttataaattgcaaagactcactaatggttttcagatgattggttatttggtaaattggctttcagtgggtcaatgaaatggtcattaggagaactgtcaataaatttatctgctttcttttaaaaaaacatcccattttcccagggtagaaatgaggggtttttttttttttttttataaaaaaagtaacgcttcacaaatttgcgtgccatctttgcacaggtgccataccaccttctctgtatcattctagttttagtatatgtgttgccaatgtggacactagaaatcagttttgttttgtacttaatagagcatctttttaaatcttatgcacagaagaatgatgcatagaagaatctgtaatgcataagaagcatcttatgcattatcttttgaatcttatgcatagaagaatatataatgcataagaacaacgcattatatattaattagattaaattaactccattcggatacctaaggttatatttgtgtattaaactcctcaacatcagggtaaaagcaaagacaacatggcatcagattctttgtccaccggttttatttagtctcagagacccaagctggtcagcatttggctctggtggagtcaccatagcctggatttgaaggtttggagcccagcccaggtttggaggatcagtaagttggtatgccagcactccaagagagagaccatctctttgtcatggacacgtcctagctatgtatctaaggtttattagtacaatgaatttctatttaatggctttaatttagaacagttttcttgaaagcctcaacattggtattccattgtctgggcattttttctatatagggaaaatatacaaaagccacatcataaccaggaagatgtatggtgagctggtattcaagaaaggagaagtagctgtgagacaccaaggattggctgtaccagattaagataacctaatccacgtgtctctataagtggctgggtcagctgttggaacctgttgggacagaacaggttgaatccttgagcaaagaggccaggtgaggtgactcacacctgtaattccaggactttgtaaggtgggccgatcacttgaggtcaggagttcgagaccagcttggccaacatggtgaaaccccatttctaccaaaaatacaaaaattagcagagcatgatggtgcgtgcctgttatcccagctacttgggaggctgaggcaggagcattccttgaatccaggaggcagaagttgcagtcagctgagatcgcgtcattgcactccagcctgggtgacaagagcgagattccatctcaaaaacaaaaaacgaaaaaaaacccaaaactaaacaaaataaacacatatcctcacctttttgtgtgtgggacatacagtatgaaaagatgagtgctaatagctttccccttacctttcaagagaacctaaagatacttgcctccattccagtcatcttcctccctttcaatgagactgtgttcttgcttgctttgggggagaaagactaagttgacttatagaatagagggatggcaaggaaacatcccaatacagtcagtatttcttgtggaaggacaaaaagagaaaagtttctgggttatgtctagaaagataattgacaggaatggggagaaggaacccagtaatggcaggtgaacgagaaaattggtacaatgataagtgttctgtaatttttatcttgagaaatggaaaagcagctcctgaaagatcctattagtgatggcttggtgttggtaggaggtggcttgacactcacagatagactttggtgttgcctgttgaacacaaacaatttcatagaatatcagcatcagacaaggccatctcaggactgtggtgggtcaggacaagacaagaccgctaggtgatcatgtctgaactcagtccaaaacatggaccttgcctaaatcgcaagatgaccattcatcttctttttctggctcacatgagtgactgctgcttcttcaccgactacagctttcgcttcactaaattcttcccttcttctggataagaactatgaagatacccagtgatataattggtctttctgacagcatccaatccagagaaaagccccaattctttaacccctactcaggatcacgtaacagaaaggcaaatcctctaagaagctggacagcatcttactgagatactccgtggttcctcatggtatatgttctcctttgcaataggtagtaaaccctactttgttcaaatacaggtgtacatttaaacatctttggctagaggacatacataatgtcattaaatttatttatttatttatttttttttgagatggagtctcactctgtttgttgccaggctggagtgcagtggcacgatctcggttcactgcatcctctgcctccgaggtccaagcgattctcctgtctcagcctctcgagtagctgggattacaggtacacaccagtatacccagctaatttttgtatttttagtagggacggggttttatcatgttggccaggatggtctcgattttctgaccttgtgatccacccgctttggcctcccaaagtgctgggattacaggcttgagccactgcgcccggccaaacaagtttttttatgtagagacagggtgtctattggtcaggctggaatggagtgatatgatcacagctcactgtagcctcgaactcctgggctcaagcagtcctcccacctcaccttcctgagtaggtaggactagagttgggaaccaccacacctggcttggtttcgggttttatagagacaaggtctccctgtgatgctcattctgatcttgaactcctggactcaagtgatcgtccttccttggtctcccaatgtgctgggattacggacatgagccaccatgcctggcaattaatttgattaagaaaaagtaaaccctatgcagaagagaacacttagcaaagttaagtcacctgcccaagaaccctcagctcccaagcagtggaatcacactttgaaccctgccattttctgtctgagcctttgttctgcctttaacatcacctccccatatggacgcaccgtcttgtctcttccatgttttcgtagtcttagttttctaccactgccagaagtaccacacatttggcaccttgaaataacaaatacatatgatctcacggttctataggtgagaaatctagttggctcatctggtttctacactgtgagtttttctcaacgctgatgtcaatggttggctgtatggactgataaggaggctctgggaagagtccattttcaaactccttcaggttgccagcaaaatttatttccttgcagctgtaaagctgaagtctccatttctttactggctggtagcagaagggcttctcttagatcctgggagctttttacgtccttttgtgaagtgtggactcttccaactcatagtcagcaatggtacgaatgcatctcatccttgaaatctcattgacttcttctgccatatgtacctcattgcagctggagaaagtcttgtgttttaaagtgcttttgtgattagatgggattttccccaataatccagagtcatctccgtatttttaggtgcatacttttgataacatctagaaaatcctatttgtcatgtcacgcatcgtattgacaggttctggggattaggacatgggtatcttggggaagtggggcataaatttgcctactgtacattgttaaacaccctcccatcctccagccatctttgactgttttagtcattctttcaatgtaaatgtacgtttctactctttcttgtttggaagctcttctctttaacatgattttgcatgtacttttgctgctaatttcttgactatacagggtaaactcccatgaaaatcatctcatttccctacatgcaggtccttagaaactgtgaggatggggtaaggctgctgccattgaagcctgcacgctcctgtgcgtttctgtagcccacctagtggacacctcagcattaggaagtatcaacatggacttgtaagaaccttcatgctgtctcctcaagcttgctagctggggcctcctagtacaacaggtgccgtgagaaacacgtgaaatggcaacagatttcagaaatggtagcaaaataaaaccagtataatgttgggcattgtgtctctcacccaacttagcattatctatattcagttgagagcaaacttggatccagttttcagccacagctactcctcttgccctttattgtttcatgtacaagttctcactgaaaaaaatatatatccacagcataatcagaatagttgttaccgaagaaaatgtaacaggatgatatttttggcgaattggctttaatgagttttgaatgaatagcttaaagtattagaaagtaaaattcaggccaggtgcggtggcttatacctgtaatcccagcactttgggagactgaggcaggtggatcacctgaggccaggagtttgagaccattctggccagtatgatgaaaccctgtctctactaaaaatacaaaaattagccaggcatggtggcgcatctgtaattccagacactcagaagtcagaggcagcagaatcgcttgaacctaggaagcaaaggttgcagtgatctgagatcataccactgcactccagcctgggtgacagggcaagactttgtctcaaaaaaaaagtagaattcagtgaacaagagtaaataattcaagaaattcaaggttgatagctataaaaatgaaattccctccctccctcccttcctccctcccttccttcctcctcccttcctccctccctcccttcctcctcccttcctccctccctcccttcctccctccctcccttcctccctccctcccttcctccctccctcccttcctcctccctcccttcctccctccctcccttcctcctcccttcctccctccctcccttcctccctccctcccttcctccctccctccctccctccctccctccctcccttcctccctccctcccttcctccctcccttcctccctccctccctccctcacttcctccctcccttcctccctccctcccttcctccctccctcccttcctccctccctccctccctcccttcctccctcccttcctccctccctcccttcctccctccctcccttcctccctcccttcctccctcccttcctccctccctcccttcctccctccctccctccctcccttcctccctccctccctccctcccttcctccctcccttcctccctccatccctccctccctcacttcctccctcccttccttcctctcttgctctttctctttctctcttcctttccctctttctctctgtccctctttcttttttcttcttgtctacttcctctccttcctctccttcctcttcttctctcttttctctctcactctctgtctcttccttctttctctttctttgtacatgtataatttgaagaccctgcgccaagcagtctcttggaattagaagcaccttaaaatgaaaaaaatgtctcgccactgtgacaaatccacaggccttgcaagaaaccctgcagatcactaacacacggccataggaatatattgactgcagcccaagcacaggagaagattaatcaatccaacagacttgcattaattgtgaaatggaagggatgatgcgatcaatgataggaatgaaagtgcagcagtaacgatgccacatccagctaatccaataatggagaagctgatgtatagcatattggaattctaccgtctgggcacttgtcaccataaagaatatcctagaattatagggaaaaattgagcaggcagcagttgagccaacctaatcagcctgataccacagtagttctcttgattaaacactaaattaagtggcattcagctctgtaacctgcttgccttgtgaaaaataatactagagctaacgtgaaaagtttgtattttaatcaaagcaaactacgaatattaaaatattcctgggctattttggtgccgtttagctgtgaacaagtttaataatttataaatggttcttttgccattggctacaaggaaaaagggtccaaagctatattgggaggtaaggcttcctgtgctaaaaatcaattagacttgatagaagctcagagaactcttaagaaaaaaaaaatgcactcaagaggccctgggagaattcaaatttagttaacttctataacggtttgcctaagggcatgaactctattctttgctgcaaagcacgtgatcattccaggaggggtgagacttaatcagctgtgaatactatgagggtcccttatacatatatgtcattattaagtcctgaagctcaaatacacagacaacctagagctaaatggcaaattctccaggaccaagagaaaactgcttttcatgaacatttagagaacactagagaaagaacttacattgtgagcatcaaacccagtctggttagactttctgtacagactcttacgctaggacacacactggtgagatcttggtgattattatatgcattggccagtgagacctcttagagttgaccgagtccgtgagcatccgaggggctagatctctggtggccagtgaaggagatgtgggttggaaaaggagggagagacactgatcacatctccccttttttttttgtttgtttgtttctttttttgagacagagtttttctctgtcacccaggctagagtgtggtggagtgatcttggatgacttaaaccaatggctctctggtaccgcctcctgggttcaagagattctcctgcctcagcctaccaagtagctgggattacacttgcatgccaccactgcccggctgatttttgtatttttagtagagacatggtttctccatgttggccaggctggtctcaaactcctggcctcaagtgatctacccatctctgcctctgcctccgcctcccaaagtgctgggattataggcatgagccactgctcccggcccacatctcttttcttgagcagaagatagtgtgctgataaagttctcccaccaaagtgagtcttagcagggccttgggcaagaggataaattaactacttaggctgttctttcctgttatattttgtttgttgtttgtttgtttttatttcaagtcaatttgtggccttgccttttaattgaaagcaaattcatttttttttttttcctgggtgggaaagggtcactgaaagaagagaggccatcaggctgtgtcttacatagttgaaaagtcaaaaactgcagacagatttggatttatttgatttcaataattagcagtcattcgtggagtcctcataccattccagggctggttctaagggcttttgcaacattaacttatgtaattcttttaatgattctgaggtcaagatgctatcatcattttcactttgcagaaggagaaactgaagcccagaaagcttaagcaatttgccaaggtcttaaagagtgcaagtgtggcagatggggattgaaaccaggcgggctgtttgttgctatgtgtttttaaaacaggttgggccttccaagttggatttttgtttgtttgtttttgttgtgtgtgtttgtttgtttttgttgtgcgtttgttttgttttgttttgtttgttttttgagacgaagtcttgctttgtcgcacaggctggagtgcagtggcatgatctcggctcactgcaagctccgcatcccgggttcacgccattatccagcctcagccttcaaagtacctgggactacaggtgcctgccaccatgctcggctaattttttgtatttttagtagagatgggagtttcaccatgttagtcaggatggtctcgatctcctgacctcgtgatccgcctgccttggccttccaaagtgctgggattacaggcgtgagccgccgcaccgtgccccaagttgtttttggacagtgatatcagtcatgagaaatgggaaggagtgggatgcctttggatgatgttagctcaagtggtattgcatgctcttccaccccatcttctgcacatttctctctggaaatacgcccttcattaatcctctgacattggctaagtagatcatgatgtggtgttctgatcaatgaggtctagtccagtcactgtaggtcaaatcagattatccagacctccaaaataataagtggactttaggtcagacgtatggagtcaccaatgagaaacagcttcagaatccatccagcaaagatctagaataatcataggatgagactatgatcactatcatttattgaccatcactgaatgctgggagctcttgcgggtgtttttgttcaacttgcttaactcataacatcagcaagatgaaagaaattttcccagttttaaagatacaggatctgaggctgacagaccaaatgtctggcaggtgagatctcataactactagtgacagacctgggactgaatcaggtctcttcaattccatcaccttttgtctatgaaagtactcatccttcaggtttctgaggccacatgggtgtgtcataggcaaggagccttcaatcatagatgacatggaaagtcgcatctgtctcatttcccaagccatgttaataactgcctggaacagacagtgagaaaaacaaggacattggaacaccttatttctggtttcctttctctcttgtacagtgtgatttttaaatgctgctaacaaaacattggaacagaattgtgctccagaaaaaaatgagatccaacagacctttctttattatgggacaattaattttaagctgactttatcagcaaagggaggccagagtgacttgctttgtaattgttgggaagctgtgcacactggattagaggagaagtaatgtttcctttcaagttttgacccattttaacaaactgatatcttagtgtgttcaggctgccataacaaaatgccgtagactgggtggcttgaacaagagctatttattttcccatagctggggaggctggaagttcaagatcagggtgccaagatggtcaggtcctggtggaggctctctttgtggttggcagatggccaccttctcaatgtgtcttcagtggcgtttcctcagtgtgtacaggtggagagagagagaaagcaagccctctctttctctccttttaagggcagtaatccccttatgaggatcttacttttatgatgttatcttctcaaaagtcccatctccaaatgtctttagactgagggttagggatttcacatacaaatttgtggtgtaatgctctgatactcattggctttgtgactgagattgagccatttagttctctaagcatcctttctttggtgaaaaaatgcttgtagtccctactcacataggactgctgaggtaattcaatgaagtaaggtatgctaggagcttaactcagtgttctgctcatgttatacgtgcaataaacataaaccagtccctctcacttgaaggaaaaattgcccactttctgacccagagaacatgtgacaatgtctggagacatgtttggttgctacgactgggaagaggatgctactcgcatctagcagatggagtgaaggcatgcctctaaatatcctgcattacacaggacagtccccaaagcaaagaattgtctgtatcaaaatgttagcagtgctgatgttgagaaactctggtataacctatcattgcaacacaactactaatgttatattacctggaatcagggaggagggaggatgccattaacaaattatataaagtctgttttttaagagagactgtttttctctgttgcccaggctggagtgcactggcacaatcactgctcactgcagcctcaaactcccaggctcaagcaatcctcttatcttagcctcccaaggaggtggaactacaggtgtgcaccaacatgcccagttaattttttaaaaacttgtagaaatggggtctcaccatgttacccaggtcattcttgagctcttgatctccaaaaatcttcctgcctcagcctcccaaagggctgggattacagatttgagccacggcgcttggctaaaatgctatatactctattccgtacgtcagtattctcactaaaagaaggaagagtaggtttcaaggaacttgaggatgaaatatgtaacagtattcactcagtatattaaaaataaatacacaatgtcattggaatggccgatttattgggacaggcaattgtgtatgcagaataaatgctcaaaaagaactgtccaaggtgctgaaactttgacaaatgaaaataacctgttcaaaatgatgtgtaaactgaaggttttgtttgtttttgaagtggagtctcgctctgtcgcccaggctggagtgtgcagtggcatgattttggctcactacaatgttagcctcctgggttcaagcaatcctcccacgtcagcctccctagtagccaggattacagtcatgcatcaccacgcctggcttttttttatttttatttttttgtttttattttattttatttttttttaaagtaggggtggggttttaccatgttggccaggctgatctcgaactcctgacctcaggtgatccactctcctcccacagtgctaggattacagtgataagcctcccaaagtgctagaattacaggagtgagacactgcaccccgtcttaaactgaattttaaaggggataactgtctttgcaaaaatacatttaaaaggttgggaaaatatattttggatttgattctcagtctttcaaggtaatgggaatggaatcttgagtgagagagagtggatgataaactagaagccaagttctttaccaggttgttttttcgagatggagtctcgctctgtcacccaggctggagtgcagtggcactgtctcggctcactgcaacctccgtctccaggattcaagcacttctcctgcattagcctcctgagtagctgagattacaggcatgtgccaccacacccggctaatttttttgtatttttactagaggcacttttgaacatattggccaggctggtctcaaactgctgacgttgtgatatacccgcctggacctcccaaagggctggaattacaggtgtgagccaccgtgcttagcttctttaccaggttctatgcttcctgaatgcagggattctgtttatctttttcttgcattatggaatagcataaacttggggtctgagacagagttaagggtcagttcatgttctctttttcctttcttcttagtcactctcagtagtctggatttgttgtggtgacagcagcagatgcatccagtggcattgtgaaggcattagtatcattataggcgctgaggctatgggtgagcatatggcctgggactgcaaatcagaaactgctcgcattcctgggattgttcttctagactatggagtagatctggagcttggcttcttagccttttctgggcatcagaaccacctcagagttggcaaaaacaaagaaacttgagccgtattatagacttatggaatctgaatcttctggagtataaggcactgagcaggaagttttgctcatcagtgttcagacagaggctggggagaggaaaaagtgtttttcccttcccaaatcaagcatcaattaattctcaggactgctttggatagaaggttgttcacattattctgagattttggcttatttaagagcctattagacaccatttgtggttcatctcctcttgtttaaaaggctcttttgagcaaacaagaagtatttgaaatttttttatgactagcggtctagttattcacatttctattatgttccattccattcccaataattcattttaataacattttctttttttttcttaaagattttttttttctgactaataacattttctgatttgggtagaaagaaatattattccacaataagcaattgtgaaatactaaatttacttggctttaattacatctatagaggtaagcaacgtgtttcagggaaatctaacttctctttgaagggtaaagacccagttaattcatcatttacccattatttggtgtgataggcaacaccagtagttattgctgtgtggtgatagggtttctttcttggaaagactacacttcctagtcactcattgcagttaagtgagaccataaggcttgttcttgccaatgaattgtaggcttagtaaagttcatcacttctgggacaaagcatggaagagtgagacaccaccagacatgaccatcccttgccgcggtgaatttgaagtcctttgttgagatcaggaaatcgccatcaacatgtatccccaagtaattatgtggaacgggacctgcctcatccccaagatctgtctcggacatgtggtagatccttctgccatactattcaaactgaagactgggagttaatatggtgtcatggtataaactagcctatagagttgagttttagaagaagcctttcggatactgaaaacaaggcactgaacttaaattctgcagactggatttaaatctgggctcatgtttctcacttgtttcgggacgtaacctaagtcactgaactgccgtgataacagacacagccacagtgtattcagcacacctatgtgccaagcattgcacacagcgttttgcatatatcatctcacgtaattcctccagccacacttccacttgggtagacacgcctcacttggtggatgtggaaacaggcgtgatacacgatgcaaaaccagaaagtggaaatgctgaacttgaagtcacatgtgactgatgcctattcccgtatttttcttttttctaaagtggagttgattaaactgtctacttcactgggccgttttaggatgctgtgagcagggtaggtgacaggacgtggttacccgccaggtgaggttattgtgatttggtttcggccagcacttgctgcagagaacttaagactgtttcttttctggctgtcacttgaccctgtgtaccaaccttgaaatccctcactggcattttggtaaatttgtttcatgtttttgtcccatcagtagtaaaggtttcaccattattttcatttcctggttgagcgaccctctttctttcatgacttttggcttcatccttcagcctctttctctttttttattgttccatgttgctgtgagcagaactcatttttcaaaagacagatggtggcaaccctgttctctctaaataaaaaagcaaaacagctgttaaggtgcaaacagagtcgcggccagcaaatcgtatctgcttcaagtgttggcgaagtttcccttcagggaatgggagctatctaaacaaaatgtgcagcctcggctgtgctctgccaaggcccaagtatagaatgatggcaaataatggaaatttatagtgtactatagatccagcacctttctatcttggcgggtgcatatttaaatgcagtgctaacggagctgaaatttatggctctctaataacgataaaatgccatcagagaatgagataaatcttggccccaaaccttagcatgcaacgcacacactgacgcgcgcacacatgcttgtaaaatatagccagatactgctaactcaggagtctgcgtttggaagaagccaacggaacagagaaagtagaggaagtgttttatagacgactgcaaattgttgttttcatgaggctggggtcaaggtacattgtggcctcaggttgaaatgagtgttgctttgtctcatggctgatacatgcttgaccttggtgagggaagcttttccttttctagatgttcaatagcttttctcttcacgttttcacaaccctgtgacaggccaacttccaaacaaacactgatgaattatcaccctctgggaaaagaacatcgtggtgtgcttaagcgttttcttctgtttgtttatttatttatttgtgcattcattcattcagagagaattggagtcttcgaggcttagcaacaacagagagatgaaagacatttaccaaaatgctatatttgcaaactgtcggcgacgtgtgaattaggtgtgccccctttctctacgggcagttgtggtcttcagggaatggaattttacaaaatatcatttaggaggttgtcattcacgtttgaaaacaggcgtggccagctcctccagccaacctgcatgtacacccagctgttttctctctgtggagcatctaggtcttaggaagggaagcccatctggaaatctgtcttaagcccttgctgaatttccacgagccgtgcattcgtggatcctgcaagttagtaactacctgaagaagggggcattctctactggcttgcattctaggtgtttcctccagcttctccttatgcaaggggacttctaatattttgggcgagatgtttagtttcagtgagaagcctaacctccgggagttgtttcaggccacctccattaagagttagatacttctttctagatgcttctttatgcataattgtgtgtgcgtgggtgttcatgaatattgtcttaattgctcctgtttttgaaatacaacgtctaatccagtctatcattgatggacatttggattggttccatgtctttgctattgtgattagtgccgcagtaaacatacatgtgcatgtgtccttatagcagcataatttataatcctttgggtatttacccagtaatgggatgactgggtcaaatgttatttctagttctagatccttgaggaattgccacactgtgttccacaacattaggagatatacctaatgtaaatgacatgttaatgggtgcagcacaccaacatggcacctgtatacacatgtaacaaacctgcacgttgtgcacatgtaccctataccttaaagtattaaaaaaaaaaaagaagaaatacaacgtctacagattaaaacccactctaggccaggtgcagtggctgacgactgtaatctcagcacattgggaggccaaagtgggaggatctcttgagctcaggagttcaagaccagcctgggcaacacagtgagacctcgtctctacaaaaaaattaaaaagcaataaataaataaataagcaaagaagaagcaaaaagaaagcgttcttgttcagaactgaaaaaaactgttcctggtttcctagtttttagaagtgtgtgtgtgtgagtgtgtgtatgtctgtgtgtgtatgtgtaaagactgagaggtaatgatactgattgagttgaaaataaccattcctttgtaatatttctaaaattttttaggacactaaattattttatataaaattatataatattaggtggtttggtgtgtttgccttgtttaggttttgttaggttggtgcttgagaaaaaaacaggtagatttggaaaatgctgatgtttaggatgaaaagggatccaatttttcatataaaatgaattctttggagtaagaccttttagctgagattcatggacttcatgaaagtatgtgtgtgtttgtgtgagtgggagagagagagtgggagagtgcattcatgctgttgtaggttttgctaagagattttgtactttttgttaagttgtcaaaagctctcttgtctgaacccctgagcccatggtcctctctctcctcttgtttgtgctgtggatttgcagttactttacagttcgaatgaatgatctgttctgtgaatacgtagtttcattttacagttagaatgatgtgatcagggctgtgattcctaggctaggccattactgggaaaggtgtgacttggaccagaaaaaaagtaaggaagtgaatctcatgctaaagagaacaagcttggtttcaaacactgcatgtttatgggctttgcccaccaggtttagcttgtacaaggaaatacccacgccccaattcccattaatcctgaacatatgattctctctagctgttccacacctcccaatctgtggtccagcaatactgacatttttgcgtgtgttccaactaaaccctgctctcttttacctcccagcctttccacattttgttctctccacctgaaactatattccctttcttctggctctctcttttttttttttttctctgatgaagtgctgctaccctcaggaaggcgtctgtagtgttttctagatcagcttaggtgaacctttcatgtcttcctgtagcctccccacttccattgtcaaggtatttactacaattgtcatgtctcaggccaggtgcggcgtacccggggactcttttatgccatctttatacctctgtgtaaatctaaaatattttcttttttttctttgtttctttgtttctttctttatttcctctttttttagacagaatcttgccctgttacccaggctggagtgcagaggcacagtcttggctcactgcaacctctgtccgccaggttcaagtgattctcctgcctcagcctacggagtagctgggattacaggctgccatgcccagctacttttttgtagttttagtagagatgaggtttcaccatgctggtgaggctggtcttgaactcctgatcttgtcatccacctgcctcaacctcccaaagtgctgggatttcaggcgtcagccaccgcgcccagccaatctaaaatattttcaaaatataatgtttatgaaaattaaataaaataaggaatctaggtcaatatctgtgttttatcaaagcaaccagaagatcagacatgtccacataaagagtgatgaacttgtattaacagaaaaggaaatgacattggacactgtctgtgtcatcacactgcagagggaagaggaagaggaggagggaaatgtccttccctctgagaaccatgagctcagtgaaatccctgcattcccacccacatccttaatgttcccagtatccaccaccctgaccggcttaagtgagcacttaagaatttttctcgaggccagtcttgaaggctcatgcctgtaatcccagaactttgcgatgctaagacaggcaaatcgcttgaggccaggagttctagaccagcatggccaacatggtgaaatcctgtctctacttaaaaatacaaaaattagttgggcatagtggcaggcatctgtaatcccagctactggggaggctgaggcaggagaatcggttgaacctgggaggcagaggctgcagtgagcccaggtcgtgctactgcactccagcatgagtgagagagcaagactctttttcaaaaaaattgttttttgttgaataaatgaataaacgaagcatcacaggacaagggaaacttgtctcttctcagttagttgctgagtaaattgttgtttcttatgtgttgcgtcggcccccacctcatttggttactacttgagtcctcttggtttcattttattttctctctctctctatatatatatatttactttttaatatttaaaaacatttttgaatattttagtatttatgttcttatatattttaaaatatttttatttttaaatttgttttatgtatgttttttatatatttgtatatatgttttatatatcagtattaatttttaatataatttatattgtatatattttatattaatattttatataaatattatattttataaaatttataaaattttataaaatttttatatttataaaatatattatattttataaaatatataaaagtaaaatattttattttttataaaatataatattttataaattatataaaaattttattaaaatttttatttccctcagcctatttgcacagactggattaagtgtccatcatagtatttaccaagctttttgcacataacaaaaatgaccctaaaaacaagagtaacagtttttatttattgagcatgtactatataccaggcatgcttgaaaagcctttatagatttatttctaattcttgaaggtagttggtattatcttcattctaaattgccagaaccttctttctctctctttctttctttcttttctttctttctttcttttctttctttctttattttcttttctttctttcttttctttctctctctctctccctccccttccccctccccttccccctccccctctccctccccttcccttccccctccccttcccctccccttccccctccccttccccctcccctttcctttcctttcctttccacagggtctcactgtgtcacccagattggagtgtggtggagcaatctccactcactgcaacctctgcctcctgggttataaatgatcctcccacctcagcctcctgagtagctgggactacagacacacccctaatttttgtattctttggtagagacgggatttcaccatgttggccaggttcgtcttgaactcaagacattaagtgatccacccacctcagcctcccaaagtgctgggattgcaggcatgaaccaccactgcacctggccgtgaaccccatattcttaaagatggtagagctgggattcgaagtcaggtctgcttaaacccagagcatatcttcatgccccacatttccctctgtctctctgagtttatggagttggttagaaatgtcgtatttctttttctttctttatactccagattccctgtgaggtcaggaactaggcctttttcatgataaccctagtgaagatcctaattttgaaaacttatctaatatttattgggaagctgttgtgagccaagcactgcagtaggctctggatatattaggcccatccccgtatagagctgacatgtagcagatgaaagcagaaaaagagaaaaaaaggtaagtaggcaaaatgaggaaaaacgaagtcttagtatgggccaaacagtttcctaatgtttggtatattagctcattttatccatgagacaagttctattcttattgacctgattttatatccaaggaagctgaggggcagagaatttgaacaactgcctccaatgttcacacagctagaatgctgcagaactagggcttgcaccccattgtctcactcttgagtcttcattctttatcactaaatagacacagccaggaaggaggcagaatgggcagtgaaatgcttttgcagaagttggcatttaatgtgaaggttgaaaaataagaaggaatgaccatttgaagtgtagagataagagaatcctatgcaaaaagcccagccagtgcaaaggcactgaggtaggagagagctgagtaaattcaaagaaaataaaacacatagtgggaggctgcagaaggagggaggtaatgaccattatgaaatgaatgggctgggcatggtagctcatgactataatcctatcactttgggaggccaaggcgggtggattgcctgaggtcaggagtccaagaccagaccgcatctctactaaaaatacaaaaagttagctgggagtggtggtgcatgcctgtaatcccagctacttgggaggctgagacaggagaattgcttgaacccaggaggcagaggttgcagtgagccgagatcatgtcattgaattctagcctggatgacagagtgagactccatctcaaaaaaaaaaagagagaaatgaatgatgggcttgagttgggtggagcacttgatgccagggctttaagaacagcctggccaacatggtgaaacttcgtctgtactaaaaaaaaaaaaaaaaaaaaaaaaaaaaaattagcttgccatagtggtacatgactataatttcagcactgggaaggccccagtataccttggaactcctctgcctaggttatctcccttgtcttaaatcagagatgggtgttacttactctacagtacacagaaacaggtatcacttatcaatccctgtgttcttttccacttagctcaaatacagcctcggcatccttctgaacactctggagtaggctgccatttttaatcacccagatgttaaatttattcatcatccctatatatatttcccacaggatcaaagtatatcgagtttggaaagggagttgaaaacaaggaagactccctgcttttgattcccatgagggcaatagctgtcactctcctaggggatgttttgataagacagccacttaggtttctatatcctcctgataaccgtatgttgaaaaaggatttaagaggaaggtcataaaaccagggatttcttaacagcagggtgtggcttggcttactaagaatatacttgtgatgcattttaatgacatgctttatgttatcatattaaagattgtaaaagcatctagtaatcatttaataaatattaatgaagcatttacaaattgcaccttaatttacagcattggcactcatatcgtgctctggacatgaatgcacagagacatggtggctttgacaaagactaccatggagagcctggttctgtgacattgtgccatcctggtaccataagtgattttttaaaataataattcttggagggcagttgagtgcaatgaagcttgatgcctaaagcagttttagcaattatttttctgtttggggaacattaaaacataatctaccatgaatttataatccatagcttctctctcatgcacttcttaataataagcagtagttataggcccttgtgcaaaaattctttgtagatgttaggagatacttcctcattgtgtaaacactggggcaggtaagggatatattgcaagcgataactgtggggtcgccactcccctgccaccatctttgtttgatgcttagggagatctcctgttctttgcaggcacttagatacgaatggaggagccccaggcacaaattcctcagcactctgtcctgctcttgttgctggacttgattgtctttcagacagtgcattcaatgttgagttcagagccattccctgcaattccctctggaccctgttggatgttaaccacgatggttctcacacggggctgggtgtcacgtggctcacagaaaactacagatggaagggccttagaagtcacctgctgcactcctcactttatagaggaggacactgaggcccagagaggaacaggacattcacaggccacacaccaggcaagaagcagagatgaaactgttacaggcaaggggctggatcccgaccccaagagagcgttctcagatctcccgcaagacaagagttgagggcgtgtctgtagagtgaagcgaaagtatgtttattaagaatgtagaggaataaaagaatgtccactccatagacagaacagccctgaaggctgctgcctgcccatttttatggttatttcttgatgatatgctaaacaaggggtgaattactcatgtctcccctttttagaccatatagggtaactctgtgatgttgccatggtgtttggaaactatcatggcgctcgtgagtatagcagtgaggacgaccagaggtccctctcagggccatctgggttttgatgggttttggctggcttctttactgcaaactgtttttatcagcaaggtccttatgacctgtattttgtgctgacctcctattttatcgtatgacttagaatgcctaaccttctgggaatgcatcctagtaggtctcagccttgttgtacccagcccctatggaagatggagttgctctggttcaaacacctctgacaaaaccggatcccaagacataagattgtgcagtgtgcatttgcatgcttctcagcctcagagctaaggagacctgggcatgtcctgggggggttttggatagaggggggcacctcttcatcaggggtgctggagaaggcctggcctggcctctggagcctgccgcactgccagtcaggacatcctagctgagcaggagccatgggcgtcccggggaatcctaggtactgagaggagatggccagcagatggcgctgcagggattcaaactggagcagccatatctgacagcaaccccaggtcagggattcaaagctccagcaaccaggatgagctgcttaatagtacaggcctggacttcagggatgcctagacccctctcgggagctcccacctggcctggaaagagagccaggtctagaatgggctggtgcaggtatctgtagactggtcatactgggtttgggatcagaccccagaccaagaaggaacaaagggaaaacaaaaggactagcgcagctgctgtgtccaggctggggtgcttgctatgtgggcaggactatggtcacaggccagggtggaaatggcagccagaaggcctccctctgcgtggggtctcccttaaacccaacttcttggggcctactctgaggacatcaagaccgtctcttctaggaaggcaagaggccaacacccatgaagctgctgtttttcctttcctgctcctgacttggaggcgtggagattgccaccaggccatgtttaatgtcttttaattaacggtttaactcgggtatccatgatgcaagggttttgcaaaggaattcaatctagttttcaaaattgcagaattaagtgggtaaagaacagttgagggcagcacttacatttctgaatatttagactctttttttcttcttctttcatttttttcacacttccaatctgcctcttttcttcttctctctgtttctatctctctcacacacatacacaatcacagctgcttcatacggcttctccccgtcccctctcctggcagctgtggcgtttctgcacagaggtgcagggaaggaggaaaggccttgggtcccctggtcaggatccagctgaaacaaccagaaatactgtccctgtacctctcaggtcgggtgacttactgtgcctctgaaccctctttcttccatacctcccctacccaattccgaggcctcaactttgtgctgccagagggcactatgccacctttaaatgagatttagaaaaagtttacacatggcacctgctgatctggacattccagtcggcttgctgtatctcctagttgcaagggagggctttgcttagagcagcctgtgccccgtagggtaataccggagctggcggcctcccaggaaggctgcaaagtgcttgggtgctttgccctctctgaagcatacatcagcacccctaaggtttagctgtgctgcagccacagcccacacactcctccattctccctgaacaataggacccttgctgagatagtctggtaggagaggggaggctctttcctgaacccgtctctcctaaacgctttctatgccttagagtgctaagaacagtctaccctccttacgagactgagtgtttcctgaaggcaggagctgtatcttattgaactctccagcgcacagaaaaaactcataaatatttgttcaactaataaacaagtaaatgaatagagaggatgaataatcttttagggtaagttaattacatctattttatttaaaatgcattatagaattttgtctctgtgccaggaactgcttaaagtattttttagatataatctcatagatgcctaacaaaaaccctgtaagttagacacccttaacatctccttttttcaggtggaataggagaggtacagattgggtaggtaacttgcccaaggtcaggcagagccaggattcaaactcaagcagtctggcttcagggcttttttttctaaatcactccctgtggtttctcttagtcttagaccaagactaatgtacttagaaatacccagccagggaacaagaatgcatagaatttaatcccccaagcccaactttcattattcagctttcaaaagacatggcagggaaggtttccagacagaagaggaatagtcagtttgtttttaattcaccagtaaaacaaatagacttctttccttttatatttgtaacatacagcttgcatttttttttattttaaacaagaaaaggaagaaataaatgagaaagaagggaaggaaggtggaggaggtgggagagagaaaggagagggaggagagggaaaccgggagaaaaaaagaagggagaagagaagggaggaagaaaagaagggaaaagagaaggaaggagggagagaaggggaaggaaaaggaaggaagaaacaagggtggaaggacgaaaggcaagaaggaagggaagaaggagaaggaaagaaaggaagccttatttaatctccagcacagaaagtgttcgcagccctgagaaacgtggtttctcatttgcctgttacttggcacagtttgactgcctagaagcctgcagaaatattggaagtcaaggtccaatataataattggcttacagatttgaagaaggatagatagactcttccatttccaagattcattagtccagctttctccgtaatagacagggcttgctctacgtgtaagccattttctaatcaaattggcacacagttcatgctctgacttggtataaatgggcttctgtgaaattgctctgcctgggctcagggctggagttagatgggatggattttatctctctgatgcttgatcatcttgggctctgcatggaggaaacctgtctctactaaaaatataaaattagctgggcgtggtggctcatgcctgtaatcccagctccttgggaggctgaggcaggagaatcgcttgaacccgggaggcggaggttgcagtgagctgaggttgaagcattgcactccaacctgggcaataagagtgaaactccctcacacacacacacacacacacacacaaaaaaaaaaaaaaaaaaaaaaaaaattgaaccacacatcattgtgacttctatttgtgaaatgttcccaaaggatatttgaaaatgtgaaccaactgtgaattattgcaggacttgatatgcacaggaaatgtaatagggacgtggaggttcgtaatgtgagtttggaaaccatggaacatccaaacattggcgatcaacaaagccagcagtatgtggacagcttatgagaaaaggtgtgggcatcgcttggatctgagtgggaatccaagctctgccactcagctatgtgttgctaggaaagtttgcaagcatctatgaaataatgaaagtttaaatgaccatagcagcaagcatgctgtttggaagaccaatctccagatgaacttaactaacggtttctagtaatgctaagcataaaacagaaaaaaaaaagctatatatatatatatatatatatatatatatatatacacacacacacacacacacacacacacacacacacacacatatacgtatatatatatgtgtatatatgtatatatatacacatatatatacgtatacgtgtatatatacacatatgtatacgtatacgtatatatatacacacatatatatacgtatacgtatatatatacacacatatatatacgtatacgtatatatatacacatatatatatacgtatatgtatatatatataaaatcaagaagagccagaagagattggaaagctctttggccctgatagaagaaagctgatgcgtcacacagaagaaacatgagtcttcagttcttcttttgctcttgtcttctctgtcaagaaaaatcatcttcagtcaggatggaatagagtttggtttaggtgacaaagtcagtgttggtgaagcagaatgaagagagtgctagctcttaagaaatctaatattttacctggactaatatctccaaacaggagagtaacttggacatgagatcattaagtatcattgacaatttgtggcaaaaagcagaagggtatgagatttgaaatgcggaaataggatattctaattttcaaaacagatgaaagaagctgggagactctataattatagggtggtagcatctcatggtgtaaccactattaatggttcacttgttcaatgattaaagtcccatgtgatctgatcttcacatgaatctggacattatgaaaagcatggcttgtggatttcttgaagatgaaagaatgataacttgattcttatgtccattcattgggaataatgaagacccagcaaatgccatttcttctcactagaatgggagatttggagaatggggtagacacatgatgtgtgaattccagcaagacagtcaacaaggacacacttttcggtcacgtgtgtgtgatccctttatgggaaaagtggaggatggtgggatagatagtcagaaaagtatgtgggaaagtaaaacattattacaaattggtgccaaaaattataatgagtagattggcccataaccctggtggttttaattgtagtgatgtcattgagctttgttctgagatatgtcctgatggcattttttctaaatggttggatcatgatagagaaggctgttcttcagtgacacagatgggatggagtggagtgcctctgtttaatggagtcaggactttcatacccattttacagatgaggaaatgaggcatatgaaatgtattcatttcctagcattgccataagttaacgccaactggatggctttaaaacaacagaagtttattcattcaaggttctggaggccacaagtctgaaatcaaaatgtcagcaaggccaagttccttctgaaggctctagggtagaatccttccttccttctcccaccttccagtggctccaggcgttccttggtttgtggccacatcactctagtctctgcctctgtcttcacatgctattgtctttgtttctctgtgtgttctttgctatttcgtatgtggacactccctttggatctaggacctactctaatctactatgattttctcttgatccttaccttatttacatctgtaaagactgtatttccaaataaggccacattctgaggttctgggtggacctgaatttgaagagacactattcaacccattatacaaagttatggggtctaattaaggccctcaaataagaggcaggtccaggacttgacttcatccgtgtctgactctaaaccacacattttttcttttgtcttaggggagataaggatagggaaatgaatccaatccttgtcatttgacaaagagtggaagggaatgtgggtatttatcttggaaataaaatgatcaagaaaggacatggggtgtgtggagcagaatgatcctgcagaaagaggacctttatgacctagttggtttgggatgggagatggtgtatgatgctgatgctgcttcttccaaggagggtagccagggttgtaagtaagactgtagactgggtggagaggaagcaactgcaggtatgctgcaggatagtggctacagctttgcatgtagagagtcagcaatgccttacagttaagaaaataaagctaagcttggctgcctggcctggaatcctgactcctctatttactcatgatgtcaactttggcaggttgtttaacctttgtgactacactgtagagataaaagcagtatcatggctgggtgctatggctcatacctgtaatctcagcactttgggaggccgaggcaggtggatcacttgaggtcaggatttcaagaccagcctggctaacatggtgaaaccccgtctctactaaaaatacaaaaattagctaggcatggtggcacatgcctgtagttctggctacttgggaggctgaggcaggagaatcacttgaacccgtaaggtggaggctgcagtgagccaagccaagatcatgccactgcactccagccgaggcaacagagtgagaccctgcctaaaaaaaaaagaaagaaaagaaaagaaaggcaatgtcaacgacatcgggcagatgtgatgaataattttgatgggattggcgagataatccagtactttataaatgctacctattgtgatttttaaaatactatactctgtgccctcaaacaacatcccgtgttttacccactgcagagaagatgcagatggcttgtgtctcatggggcctggctcacatgtaagccaacgtggtccttgctggcctgctggacacacagggagctccactaccttgccttctaactgatctctccctgatcagtataattacggaggccctgctttcttccagcagccaaattgttgggatggacttcctcgttatttgaagcatttgttactgaagttagtatggcctcctggctttgctcacatctgggaaagaaagtcgattctcctttgtatttagtggcttggaagctgccagcaactttcggatggccgtagtgtcccctcttgagaatcagagaatttcattattatttttaaaaatcttatcttggcggggtgcggtggcccacacctgtaatcccagttctttgggaggccaaggcgggcggatcgcttgaggtcaggagttcgagaccagactgaccaacatggtgaaaccccatctctactaaaaaaacaaaaacaaaaacaaaacaaaaaaatttagctgggtgtggtgggaggagcctgtagtcctagctacttgggaggctgaggcacaagaattgcttgaacccaggaggtggaggttgcagtgagctgagatcccagtgcactccaatctgggcaatagagcaagacttcatctcaaaaaacaaacaaataaataaataaataataaaaatcccatcttaattttttaaaggaaaaaaataaaacctatggtcatgagcaaattacagatcagctaaatcttatgtgggaacatctccccatctacagctatttctgtttgtttgtttgtttgtttgtttgttttgctagacgagtattttccctcctcaagctaattgcttgatggaattaaagacgataatctctaataattccagtgaacacatggttcattttcaggtagttttatcctcgaatttcacttgttattttgttgtcggtggcaaattttccttttaccctctatgagacacccccgccttgggtctacctgaactaaaaatgcgtttggtgtctccaggctcatggcatagccactctgggaaacttgtctaacttccagattctcaaatttctgcagctgagagcatgtctctcttttgggaaggaggcttttcctggctggtgggagaacagcttcaatttgggagacagtgtgagtcagcaggaataacgctaaatggctggaaatcagctcagcaaaaatagcaggagcacctactgtgtagagactgtccactagccctgtcttcagaaggcaagaaaggaatgccaactctctcctcttgggctgagtggggagatgagacagggcagggaagaaggaaagtgcagtaagcaggttctgatgacgaggcggtaaaggtgttgattttagggattatagggagaccacccgtgccttacctcctccttaaaagtccaaaaacaggacgggcacagtgggtcacgcctgtaatcctagaactttgggaggccgaggcgggcagatcacccgaggccaggagtttgagaccagcctggctgacatggtgaaaccccgtctctactaaaaatacaaaaattagccagatgtgatggcacatgcctgtaatcccagctacttgggaggctgaggcaggagattcgcttgatcccgggaggcggaggttgcagtgagccaagattgcgccactgcagtccagcctaggggatagagggagactcagtctcaaaaactgaaaacaatggtgaatgtgaacgtcctttaagaggacagagctgatcatcatgggtgatatgcttaggataactttaaagacacagaatggctccctgtggggcaacttaacagaaacaaaagcagatgaggaagggaggctgggatggggcttggttccctattgaacagtagaaagacattttgtccgggcgtggcgacttatgcctgtaatcccagcactttgggagcgtgagctggggaccagcctgagtaacatagcaaaacctcatctctactaaaaataaaacaaattagcccactagagtggcatctgcctgtgggcccagctactcaggaggctggggcaggaggattatttgagcctgggaagttcaagctgcagtgagctatgattgcactgctgcatttcaggctgggtgaccaagcaagaccctgtctaaaatgtctaaaataaaataataaaggcatttaattcaatacttagtgaatacttggatttctctccattgcggagatgaggtaggtatggcaggggatggggacgcggtggtgcaggtgtccatgccatggcttaagtgccatccctggagcaacaggacgttgtctgagtgattctcattgctggttctggattcaaatagcctgggtttgactcctggctctggtttttcctaacttggggcaccttgtttagcctctctccatctcagtgctctcatctgttcaaggggataatgataatgacagtatctactgggtaaggtccctgtaagaagtcactgtaggatgaaggcagaaagctagatcatgcctggtaatgaccaggttggtgctggaggagagggggctgaggttggagatcatcaatgcaccaggggtctcgggatgatgaagagagtcgctgccctctgcttcttcccccttcttccttgctgggctccagctggctgaaagtgtatgaccatctatctctagggcacttcagaaagatggatgggaagtgggaagaggggatgaggctgcctagagagccttgaaattttaacttctgtgaaatatccagagaagatccctggcaatgtttttgtgtctatctcattgaagacacatcagtgaggctagcagagggccctctttattggggagcagaacaggagacattcgcctttcagtgaggacacctcacatcagtgcccctgtagatttattgtgaattacctggggtttgggggaggggtctcagaaaatgcaatttctaattcacttggtctggggtggagtctaagatattgcattactttttttttttttcttttttcttttttttttttttttttgagatggagtcctgctctgttgcccaggctggagtgcagtggcgtgatctctgttcactgcaacctctgcctccccggttctatcgattctcattcctcagcctctgagtagctgggcctacaggtgcccaccaccatgcctggctaatttttgtatttttattagagacagggttttacattgttggccagggtggtctcaaacttgtggcctcaggtgatccacccgtcttggcctcccaaagtgctgggattacaggtgtgagccgctgcaccgggcctctgagacagtgcatttgtaatgagtttccaggtgatgccaacgctgttggtcctcagtctcactttgagtgttaagatcctgcaggatactccaagtgagaactgtacttgggattccgcaccctccccttcattcctcacccaggcttgcccatttgactgtggtgctggcccatttatcctagttaaagggttccacagttccctgtgattatccctcatgatacggatcacgttatacacttaaattaaataaaatgcaccctatcgaatgcactgcacacaaaaagaatatttatttgaatattaagtacagataagacttcccctgggattatttcagagcgcatttgcagaatttaattgcaatattttcccactcagtttctttctgaacgctacttgtgaaaatattttctttctgaaggtaaagctctgcgttgttggtttattattattattattttaaatctgaagagctctctgagctcggtcattacttccagtgtctaattaatcctgatgatgataaagtaaacagccaggtgacctagattttccttttaaattgctagcaattaacatgaatgcctgctcattgttgcagaacttttgggaatctagtccttccagttaggattccttaagttgggggttttaagagttcattttgtgtgaagcatatgtcttccagcactccttccattaagctttccaggaagaatgtgaacacagacacacacacacacacatatacagagcaacagtcaccaccaccacccagccaaccctttcagacaactgaactggaaaattagaaaatgaatactcctcaagtttctcaagctacagaatccttcccatttcttaaataatgacattttgtaaagtcatagaaatcagcaatagaaaagacctcttgtgtaaagatctcttcagatgcgaaagtcagaatagcatggaaagacagcctggggatgtccaccttgggtgccttctatccctatttccttgtctggagaattggtcccatgggacttagttcaccttgacatttttttttttttccatgacagccttgtagttgttacatgatttatttcttttgacattctctacaatgtgtagatgtggatttacagtgtcccatcctaaaactttcagaagcagtagccaatttttcacaatcttggttttctaccgctgtgttataggaaaggggtcccaatgcagatccccagatagggttcttggatctccctcaagaaagaattcagggcggccgggcgtggtggctcacgcttgtaatctcaatactttgggaggctgaggcaggcggattacaagggcaggagtttgagaccagcctgggtgtctgtactaaaattagaaaaattagctggatactgtggcggctgcccataatcccaactattcgggaggctgaggctggagaatcgcttgaaaccgtaaggcggaggttgcagtgaaccgaaatcgtgccactgcactccagcctcgtcgaaagagcaaaactccgtctcaaaaacaaacaaacaaacaaaaaaaacaaaaaacaaacaaagaaaaaaaaaaagaaagaattcagggaagtccatagagtaaagtgaaagcaagtttattaagaaagtaggggaataagaatggctagttcatagacagagtggatgaagggcagaggagcccctcatcagagtggatgatgagccccttggggctgcttgtttcccatttttatggttatttcttgatgacatgctaaacaaggagtagattattcatgcttcccctttttagatcatacagggtaacttcctgacgttgccatggcatttataaactgtcatggtgccagtgggagtgtggcagtgaggacaaccagaggtcaccttcgtcaccatcttggttttggtgggttttggctggcttctttactgcaaactgttctatcagcaaggtccttacgacctgtatcttgtcttgtgctgacctcctatcttatcctgtgacttagaatgccttagccatctgggaatgcagcccagtaggtcttagcctcttttttttttttttttttttttttttttgagatggagttttgctcttgttgcccaggctggagtgtgcaccggcacaatcttggctcaccataacctccacttcccaggttcaagagcttctcctgcctcagcctcccaagtagctgggattataggcatacaccaccatgccagaggtcttagcttcattttacccagcccctattcaagatggagttgctctggttcataaacctctgacaattgtgatgctgtctgctaaatatctaaggaaacagtgaggcacgtccagtccactgtcaacttatgaaaagaagaaatcacaacaacaacaacaaatggactactgaattcagtttactttcttgtagtgaaaaggcacgttatatagtgctttccgtgtgataggcactcttctaattgctttgcaaatattaactcattcaaatcatgtgatgaccctgtggggcacatgggtagacccaggcaaggaatttgttcaaggtctgtaagctaataaggagttgagttgagctttgaaccttggaagtctggctttcgattttgttctctgaaccactgcattttagatgcctctcaaatgtctctcagttaatatgatcaagatgactgcccagataaggccatggcctgtgtgtctctgctgaatctatttaattgggatgcagattataaaattatcaacttctgataaaattattattagagctctgtaatatccaatgagaaagaaaaaaaattacagttaaaacatcttaacttgaaaatgtcttgagaacatatattctatcccagtagagagattcaaatggtatgtaaatcccccacttgccctcccctccacactctttcccacctctggatgtagagagggggatgatgggaaaatcttcgctgagatgctcattctacacagagtttcctggctatagggtaacgatggtcccaggagaccggttcagggaagcatgccaagcccttttagttacccaggacattttggtgagtattgcttgaattttcttagactgagcaagggtttgggatgggatggggttgaaggagggcaattataacccttgatcatgagggaaagaaatggtgattgctttcgctgctgaaacaaatagaaatcatctttgtaataactgcaattgttttctccagccctcctctgccttggttcacaaaataccttattaaatctggagaataaaaatgtacctggggtaatggtttattattagaataaataataggcaatatgtttcttccaccctgcaaggtatcagatgccaagacatttcgtggtttagcttgtaaaggtgcttacatgtgtcagaccagccaggctcttcatggccaggggctgccctttcatttcaagaccagcatcaagcctgaagtgaacaactccacgagactgcattcttgcagaaagcagatgtgggaggccgaaggggatattggccacgtgctgcctggggctgccatgtcttgctcaatgtttgtctgtctgattaatctgtctggacctgggggacttcttttgttgataatggggtctttaccaagagggtgcatggcagagcaagtgtgaaaagcacttcctcccaagaaaacacctcattaaaacgtgtaatttgaggtttgttcaaattctgtgggcatcctgacctctgacatccctttaatcagataaccaacacttgaatctctccagtgacttatagccagagcagtgactctcttgatataagtaccattattaccaaacaatatgatgtttaaaggaatatcagaagtgctcactaaatgtgttgtcctgcctgggagatagcaccccataggtcattcgagtgctaagaatactaagtgttttgagattttaggatatgctccataaagtattcccgaggactcttagccataaattaaatatgttagagctttcagcatttgggtttattgtgcaagtttacgtataacaacaaatccattattattttttctacttagtacttagccttgacaagctctttcgtccgtctcccttgaccctccaaagctggcatcctttcaaaaccagacaagatttttacagcagataatggtcttccccaaggttaagaggaaaacatcgtgggagagctgggtgtgttctccaagctattttctcaagtgtattttgttcgtttatgcaacatgagacagaatcaagttcattaatcatggctgacttgagtcattgttgtgactttttgtttttacttttttaattgattatttctcacctcctttcctgaaacctaagcatttactagtgtaacacacttttgttcttccttgtgacaaaaagtaacaaccgccatgaccggtggtgggatctgtatttgcttatctgacataaactatcctgtcttcttagaatcagaggacacactttattgtgtgatacacttgcaagaagcagtgggtatgattacaaccatacgtcggattataggactgtattatgttcaaagatttcaggcctttataaactcaggtatctaataaacattacacatgagaccctagaagcagacgaggcaaagcgacctctctctttttattttctgtttgtacttttactttcctactgaagagaatccacacaaaaatacttatgtccctgcagaattggagcttttgttttgtttttcaagatagccaccctacatttactcttttggtgctatggggagttattttattattattattattatcattattattattattttgagacaaagtcttgctctgtcaccaggttggagtgcagtgacatgatctcagctcactgcaacctctgcctcccaggttcaagcaattctcctgcctcagcctcccgagtagctgggactacaggtgcccgccaccatgctagctagttttctgtatttttagtagagacggggtttcaccatgttggccaggatggtctcgatctcttgacctcatggtcctcctgcctcagcctcccaaagtgctgggattgcaggtgtgagccaccgtgcccggctgagttattttatagccaccattaatcacatacttactatgtgccaggccagatttggctttgatgctctacaaataacatctcatttaattattacaataaccatataactcaggcatttaaattatattattattgctgctcttagtatgaatttataaaactgatgcatgctcattgcaataagttgaagtgatataacagaatccaagattaaaaatgagaaaacctgcttctctgtcccttcttctccactattggtctggttcccaggacatcatttttctgcttttgtctgaagtttgttgtttatcattccagacttttttccaggtataaatggatatttttctgtgtgtgtaccttgtgtgtgtgcatagttttttatacacaaatggattataggttaaaaatgattttaacttgcttttgttttattttgtcatagacatcattcctgaaatcattcattttctaatggattcataatattccgtagtataggtcaaagtttggcaaattgtggccatgggccaaagacagctcactgcgtgattctgtaaataaagttttttttttgttttgtttttttgtttttttgtttttttgctggggggggaaggagtcttgctctgtcccccaggctggagtgcaatgatgcaatctctgctcattgcaacgtccacctcctgggttcaagcgattctcctgcctcagccccctgagtagctgggattacaggcaagtgccaacacgcccagctaatttttttttttttttttttttttttgtatttttagtaaatacggggtttcaccatgttggtcaggctggtgtcgaacatctgacctcatgatccacccgccttgtcctcccaaagtgctgggattacaggtgtgagccaccacatccaaccctgtaaataaaattttattggaacacagtggcacccatttgtttacacgttgtcagtggctgcttttccaccataatgggagaaccgagtagctgcaacaaagacaagagagtctgtggctctcaaagggcaatgcatttcctatttggctcttaggagaaaaagtttttcaattcctaatgtagatgaaccacaattcttttaaccatttcattacttgtggacattggcattcttctcagttctgggtctgttctgtgacaagcgctgtccttacttcctcattcgccgttgcactctggtaaagtgattcctagaatactaaccattgaattaaaggaaatggaagttctacatagtgataactgccagctgccccctcgaaacagtcagtaccaatttaccacccttcttaaaaagataatatcaaacctttcgaaaggaatctgatgctacaaaagtgtcattaatttagccaaattcacaaggcctcttggggaacaaagccaggatttggacccaagtcatttgacccagtgcttcttgtgaaaacctcctgtgtcattaatttgaataccaattgctggtatttgctgaatttttaaatgtgttaagtgctttgcttagtaattcttatagattatgctcacaataaaattagacactttgcaggtaccatattatctctatggtacaaatggggaaattgcctgcagagattatataatatggctaacgttacttaggagatgttcaaggactggacttccttagtctgattccttaacctccagtctccattggggagaaaactggatctacagaagggcccagtgctttgatatcagagaaatctaatttggtggaaattatactggttcttacctcaataagccaagtttggaaatttatgtgttttatggaactagacaacactagctagtcggtgcatgtcttgttttagagaaacacaagtgtgtaaacagcatcttgtcagggcacagtagctaatgagcacctgctaaggacaagtgaggcgcagattggggaggagggctaacagtgtaggtatccatggttttgtttggtttacctgaccctggaaactgtgtacaatggtgattcagagaggaaacctagtcaacccatccagatggtaattccctcttgaatatttcctatctttacggttttaggaattcactcactctgtgcctcagtttttccacctgtaaaatggagctaaaatcaaatcagctaatgaaatcaattgtcagctgcttacaaagttctgagaattaactaagcttataactaggaactgtttagcacattttatgacatattacaaacattggatacattttaacgaatgttagtgtgcaatttatttcagcaaaaagtgattaaggccaggtgcagtggcttgcgcctgtaatgccagcagtttgggaggcccaggcgggcggatcatttgaggtcaggagttcaagaccagcctggccaacatggcaaaactccatctctgctacaaatgcaaaaattagccgggtgtggtggcgctcacctggaatcccaggtactcgggaggctgaggcaggagaatcacttgaacctgggaggtggaggtttcagtgagctgagattgcgccactgcactccagcctgggtgacagaggaagactttgtttcaaaaataaataaataaataaagtgattaaaacaattactttcctagcagcatagttaaaattgagcaaaacctaaatattttgcaatcccaaagttccttcgcttccatcctccaccccccacaatctccctgactttatcctgcttttgactgtgccattcacggtatcttgtttctgtatccttggggaggtcctcccgcccaactcctatttactcagtaagggttagatcaagggtctcagctccagaaacaactgactgatgtctcctccactgcttcccgtccttcagcaggctgggttggtgcatctcctttgagcacccctggaaccctgttttttcttttctatcacatacgaccctgtatcatcatcattattttattcatcactcctcccctgtcttttttaaataaaatgtacaatgtgtcatttagatacacaccccctttcattagcacagcgctaggcagttagtaccctgagtacatatgtcaaatgtgtatcatagtcctgaaatgcatcaaggaaaacgcaaactccagggctcaccctaggtacttggagacgtgcgtttataggaaaatgccatcttgtttcagaagagtttataatgattacaaaaacagcaacgctgagaaataaagctaccaattgatttgatatattgagttctatgctggtaaacttgtccagtgttttccttctaagtgattcataattgtcctgaaaactggattttccaacattctattattgtggacatgaaaacatgaacatctatttatccattcatttattgtgtgtcttctgtttctttggactcctactttccccagttcaagttaatctctcaccagttccctcttgcacttgactcttgtgtcatattcaattactgcacttccataatctcactgagctttccacacatcctcctgcctttcctctgaatatatttttttcattctttacctggatacattgtctaaaagacaaaacaaaaacaaacaaaatacactaatacctttttcaattctccaagacaagttgggccacctcctatgcactgcaagcacctcttacactttcactgtacaaatgttctctgtattgtaattatccatagactcatctttttccccacctagacaatagctccagtagccttctttgctgttgtattcctggcacttaggacagtgtctgacatccagaaggtgcttgagatatgtgtatgtatatgtgcatgtgtgggtatgggtgtgtatgtgtgtgagtaaatatatatgaaaggatggatgagtaaacaagtggattccaaacatcgtactcatctctagaaaaggaaagccacctaaggctcagttctagttcttgcagagccagtctgatgtgtgggagagaaaaatcagactgaaaacagggtcagaataaagcaggaagaactgataagagagaactcaaagtcaggagaaggatgaaaaaggctgagtgagaaagcgtctttggccctgttggctaaatgaagataggagacggggaagatgaatccctgctattaaacatctcgttcaaccgggagagcaaagggtctcatgctgaagtttattgcttcagtttctaacctttcataagtgcttacttggcagccctttcaagagtggtatttgattctggaagcatcttaaaggaacagcgcccgaccttccactttactttttttcatttaggccataaaatatattggttttgtgcattactgccatgggagaaaaaaaatatcacatgttagtttccaaatgaaatgacatttgataaagtgtacatttaagatatttttcaaggctagcttttaaagaatgcacaggcagggtctttcttcatcacagactgtagggagttacaggtgcctttttttccacctcccctctccccacccggagcctctcccataatggttatggagaaaattttttaagagcctcattagttgcagcaataacttactgagtcttccaagaatcattacaccctgtttggggtgctgtttgatgagcaaggttgcagccgaaacacacaactcatgatgggattctgccgttttgtgcaatggacagctctttcttcacggaagatgtgaggaaagcatggatctgcattcgatgatccctacttaaaggaggggaggtcactggccacctaactcatgagatgtgtatgtcactggattgactcaaattggccagggactcccacttccaaacaaaggggttggcagtaggtggagtatggtggtggtggtggcaaccagtttactaataatttatgaaatggaacaggtgcatgacccaaaaaaagaagcaggatattgtcactagaatataagcaaaataatatgggatgctgtgcagggaaaaataaacacaacaaaaacaaacatgtctactatagagattacttgaaatatcctttttcttattcccaaatctcattttccttatttggcttcatttgaaggacagcatggctatttccttggctactgttggattttgcattgtctgcaataggaatatgataatgtggtgccacttcacatggcacaagtcagaggtcagtaggccccctggttccttcagtgtcgtcattgtgcttttgtgagtctggcaaatccttgtgatatttgaaggcagatgttaaaaatattaatcttgttatatactttttttttttcaatagagcgagacattgtctcgctttgttgcccaggctggagtgcagtggcttgatcttcattcactgcctacctctgccacccaggttcaagcagttctcttgcctcagcctcctgagtagctgggactacaggcgcattccaccacgtgtggctaatttttttgtatttttagtagagacagagttttaccatgttggccaggttcttctggaactcctgacctcagatgatctgcccacctcggcctcccaaagtgctgggattacaggtgtgagccaccatgcccggccaagataaactttttattaattaacgaaaatcaatgctatcactattactatacatttttaaaaacacttgtatttctgcaaggtactgatattaaaatacttgctgattataaatgccctgtatgtcacaaaggatagtttgaaaactacagaaagcattaagaaggaagcattgccctcagtctttaattgcatcagccatttagtttatattttacatgtagacaggtgttccattttgacttaatttttgtataaagtgtgaggtttaggtaaaggggtgtgtgtgtgtgtgtgtgtgtgtgtgtgtacacatccagttactctatcattatttgttctggatgtttcacttttttcggttttcttaaaggttgtgttatagggattatcacacacatatttctctcagtctacaagactcagtattttgcctctttagttggaatgcagaaaccttatcacccatgttaattagcttgacttcggtgattgtttttacaatttatacatacattaaaatatcaagttcaatacgttaaatatatgtaatttttattttttaattgtgcctcaataaagatgggagataataaagtttatcaccacgtatgcctctttgtttctgtagtctttgtgttttatctttttttttttttttttttttttggagttggggagtacagagtctcagtctgtgtgcaatggcatgatctcggctcactgcaacctccgtctcctgggttcaaacgattctcctgcctcagcctcccaaatagctgggattacaagcacgcgccatcatgcccagctaatttttgtatttttaatagagacggggttttgctgtgttgaccagactggtcttgaactcctaacctcaggtgatctgcgagcctcggtctttcaaagttctggaattacaggcgtgagcccctgcgcctggcctatattttgtttaacttccgtattgtatatccataaattaaaaagctcttcatgcacttccctcccccccagttttttgctttaagccattaaacatattttaatgaactcaagagtatagaaagctcttcatgcaatttcctttttttttttttttgctttaagccattaaacatattttaatgaactcaagagtccagtcacctattaacatttactcatatgtttaccatttccatttccagctcttcctttcttgttgtttgaagtttccttcaggtatcctatttcctttatctggaaaacttcctatagcgattattttagggcaggtctgtctgcagtgaattttcttagttactttcatatttcaccttcatttctaaaggatattttcattggatgtagtattctcagttgacaattattttttcagtatttcaataactgtgtgttattttctgctgacctctctggatttttgtttgtttagtttggattttgttttaaatccatagttctttgaattgttgggcccttacaagcattgcattgtttgtctctggttgttttcagtgttttaattttaggctttaccaatatgactgtgatatatgtggttgtggatttcgttgattttaactcttttagttccttgaaattgtttatatcttttgtcaaatgtaggaagttttcagccattatttcttaatttttttttttgcagtgaactctttatccttatattctagaatttcagtaacatgaaatattgtacgttttgatatttgttccacaggtcctgcatttctttttttttttttttttttttttttttttgtcttcaatttttttttcccctatgttgtttagaatggatactttttatgtactcaagtttacttctttttcttctgttgtcttcattctgtgtttggacaccttcagtgagattttattttattccgttttaattaattaattattttttttgagacgtctcactcttgtcacccaggctggagtgcagtggtgcagtctttactcactgcaacctccccctgccgggttcaagcgattctcctgtctcagccgtctgagtagctgggaataaaggtgcctgccacaacgcctggctaatttttgtatttttagtagagaaggggtttcaccatgttggccaggctggtctcaaattcctgacctcaggtgatccgacccgcttggcttcccaaaattctgggattacaggtgtgagccaccgtgcccagcccaatattttatttttatttttttaaaaaaatttagttatttttatggttgtaaaatttccttttgatttttttgttttgttttgtttgtttgtttgttttcgatggagtcttgctctgtctcccaggctagagtgcagtggcacaatcttggctcactgcaacctctgcctcccaggttcaagcaattttcctgcctcagcctccctagtagctgggactacagtcgcgtgtcgccacacccagctaattttttgtatttttagtagagacagggtttcatcgtattagccaggatggtctcgatctcctgacctcatgatccacccgcctcagccttccaaagtgctgggattacaggcgtgagccaccgcgcccagctccttttggttctttattatcttttgtttctttgctaatgctgtcaatttttttctcagttattttcagtgtgttttttcttaccgtttggagtcgttttataacagctgctttaaagtttttatttgataattccaacatctttgctatgttgatgttggtgtctgtgaatgtcttttcccatgcaaatttagattttcttggttcctagtatgctaagtcattttggtttgtattctgggtatattgaatattgtgttaggagactctaggtcttgtttaaaatcccatggaagttgttgatatttttgttttaataagcaatcaatcttgttgcattcaggctgaaagctcttgcttttcttctgtggatttgtttccaatatcagttctgttgggtgtctcccatatatatatcaagtctgggacatgggcagtagtctattccttagttcaattctcaaagcttatggaaacattttagggtcagatacagacatgagcacagaggtcagtgcaggagtttataaaaatactgtttgggggtgattttcccaaattattttctctccgggatcctcaaagtaatatttgttttctagggttccctgtttgttgtcctccacccagaaagctggtggttttttgtttgtttttaatttttctgttcacctgcttctcatctgagtctgcatttagggcaaagtgtcaagagaagagaggaaataaagaaaagcaatgggaggtgggagttgtttgcccaacctcttgagaccacagtcctagatgttaagtgtctgcagccacccctgttgccactgttgtttatacatgaacactaccctgagattgcctggagactgcagcataagaggacacacaaacttttaaaaagaaagaacagtaataaaaaaaaaagaacaatggggattttccctattctcttagtgttaagactcatctgtcttgtttttcaagacaaaaccagagtgcttctcctgagtctttatatggctgggtgtctgattttcagcccttggctaccttgcacccacactaaggggtattggtggtgggaggtggtaattcaccacttatgtggcggtactttaaattttggtcgttttgttcccccctccacttgctgctttttaattttcagagatctcaaatagctcccccatgcattctatacagatttccttgctgcattcagtgggggaaacaggatgaagtgttttcgctccatcttgtcaagaaccgaaacctcaccacccacttcatttattttgtgttaaaatacacataaaataaaatttaccttttttatcattttaaagtatacattttactggcatttaagtacattcacaatgttgtgcaaatatccagtttgagaacattttattcaccccaaatagaaacctcatacccattaagcagtcactcctccttttccattaacccagtcctctggcaacatttaatttgttctctgtctcaatgaattttccctacttcatcttttaacagtttatggagacataatttacataatataaagtcacctatttcaggtgtataattcaatgtgggctttttttttttggatatttatagaattgtaccagtttcttttttaattttttggaatatttctcccagtcttttcctctttagcttctttttttttcctttatttttatctttttttttttttcttttgagatggagtttcactcttgttgcccaggatggagtataatggtgggaactcagctcactgcaacctctgcctcccaggttcaagtgattctcctgcttcagccaactgagtagctgggattacagatgcccaccaccatgcccagctaatttttgtatttttagtagagaagaggtttcaccatattggccaggtttgtctcgaattcctgacctcacatgatccacccgccttggcctcccaaagtgctgggattacaggcatgagcaaccgtgcctggccttccttcattttctttaatgatctgtttcactgtatttttaacccaagataggaaccataatattgtatatttctgtggtttcttttcttaacaactaaatggtgtcttttgaacatttttcatatctctatatttaaaactatgtttctaaatggtacatgttatgccatactatcagtatactatattttttaatttttccattatcacacataatgtttataatttcttttttcatacataatgttgttgttaattgacatggaaataaacatttgtgtgcctctgcatatttttttaagagctaatcttagtggtaatatttctgggtaaaagggcatagaaaagcactgatttatagatttggggctctggtgcatccttaagtaaatattcttccttttttgtttttagagaaagtcaaaacaaactttgtatacaaaatgcgtaaaatatacatcaaaagttggttcctaaaccttcatatcccttagtaaaagtttcaaaaacttacagtatattgtctggtcctggaagtcgggagttgtttcactggttaaaaaaaaatactggaaagatatagaataaaggtgaatgaagacctaaattttatttcagcttaactattttagttgacagtggagtctaccagctcctgatgacagaatgaccatatatctcaaaattccttctatgtgttcctttttatttgtgtccttagcataatcatgtaatacgactccacccatccccttaacccacctatgttttcttgtttggataataaattatatggccactccaaagaagcgtccttggacattaagtaaaacatgtcagtagggcaaagataattaatgcatggcatatgtattgctaatacccactttcctatctgatggccgataccagaaacctatcaggatctctttctgtgattgaaggattggcttcacaattctccccagcacaatcctatggggacttactaccatctgattagaactggaccataaaatgtaacccagttgccaaggcatgacaactgacactactggccctaaacattggagaagactttgtgtgttttccactgacttatcatgaccatctggagtgggcctttatggaggaattcttgcacctgtgatatagggcaagctggggttttcagggaaaagggtggggagtttcatgacaagaggggaggtgccctcatcccaggcagatgctgcctcccacacatactcctgcacgtctctcctcttcccctttccagtctctgacttatcctagctgtgcttctgaatcacacaattgaactccaagtgaagcttgagctatgtagacctaaagaaaaattaaatacataattaattaattatgggttttctttgagctgagtaattaaaagtaactttctgttttctttcatgtttttctgatccggagccttctgacttttccccttcattttcttttctttctaggtttcaagacaacagatgaattgtgaaagagagcagctaagggtaggtgcacctgcttgtaaaatgcttcctgattctcatttttgtgtgataagcaaaaatttccttgtctctcccaagacacgggttctaaataacaggcttcatcttaagactggtagagttgaaaatatttatcccagcttatttagtattgattgagctgttaaatacagtatatcttctttggaagtgccgttatagtagatatggattttttgatttagattcagcaataaatacttttcttctggaatttgtttgacatcattgtactctttttatgtacaacacgaggtctaagtaataacaaaggtcaaaaggatggctggctgccttcttaatatgaataccaggctgtttgctgagtggctaaaatgctctttggctgttgactggggtgggtgagcaaggaatatgtcaagggcgttttctgggagaatttgtgttatctatagacctcttggttttagtgacatttgtgtatatgggagagggagacaaaattttaaaccttatattctgtttccccacttaaaaatgaaactgtcttggtgctcaggcatatcggtgtaagaagtattccctagatgtgcagggagtgtttggttataaatggagcttggtgacattgttctgctttcattgtgtcagagtggacattcttcttggtatggggatggcattttaagaaactttgggatttcttcccatttgttttcttctaaatgaattcgtgttttcagtggatgagatttagattatgattggtgtatttttcatgtcactaatggaagttggcagtttttactggacaatgtgccttatagccatgttttcaaattgttataaaaatcagagaaatatgctgcttttaaaaccacaacagtgggatttggcgttaggaaactcctgtgcccaaaggtgtctaataaataagcataatgtatttaacaggcctaatgccttcatacactgccctgtaacttttcagagcatttacctaatgatagtctcatgatggcaataatttgtagagttgcttccatttcacagttgctgttggcatcaggtttgtgaagtacttgggtaaaataaacaacagaatccaggtgcatgaaaccgagaaagtgagacaaggttttctgtttcttttatgcatatttgttttatgcagtatctcagtatggccctctctacccactttcctccaagtacctgtgccgacattcgttgtgaccctttccttcatggaacagacttcaagatttttaagcttttctgaactgtcttactgcttttttcctgtagtctgaattactggttcatcctgttaaataatgtattacaactttagatttctcttgctgtttggatggggacgatggtcagaactaggtcagagctagataaagagaaatatgtgcctttgtctccaggagtccctgataaatgcctgagaattaagataatattgaaatctctattgcaaatgacacttgcttggcaagttaaggacgcagtaggtaatgaaggacctgtttgcattttgagggattatttcccatttatgagtccattgtcgacaggagtgtggtttaggttcaagaatggagtcttcccctctctgttacataaatgcagggagtggcttgatattaacataatggttcatttagtttagtcccaagtatggctccaatagccccatctctaacatcacgaaccagtgctttgtttgttgttacttttatggtcactgttcttgctttttaaatgaatttatgttttgaattgatagatggcacatttgattggatagagcacacatatatagggttcaaaatttaaatagtaccaaagagagtgcaatggagttttcccttcccacgtgacttaggcgtctagttccctctgggagacccctagtgtgattaagtactggtagctatctcatctgtagatattttcttctgccctcttcatttttgttctctgtctttccatctctttcttcttcctttcctccctccctcttttcctttcacacctgtgtctgtaagagcccttccatcacctcaaaagaaaacttcccttattaaggtgattttttttttcggggggggggggcggggagcttttttttttttttttttttttttttagagagagtctctttctttcatcatgctggagtgccgtggcgcaatctcagttcaccgcaacctctgactccctggtttaagcaattctcgtgcctcagcctccagagtcgctgggattacaggcacgcgccaccacgcccagctaattttttttgtacttttagcagagatggggtttcaccatgttggccaggatggtctcgatctcctgacctcgtgatccgccagcctcggccccccaaggtgatgggattacaggtgtgagccactgcgccaaacctgggtgggggggcattttttaagggtttctgaaaggaatttagaactggaaggtaaatacctgtccatctcaatgaaatgcattttcctcaatctcattttgctttcttagaaagagagtggaagaaaattagaaatctgtttagttaccacatcgttgaagggtaactgtctgcaagccacaataaaaatgtgtcctaagtgcagcagtcaaaatgcatttccagatttgctatccaggatgactggactgtggccgtgttatcatgtcgagggtccttcattagtgcattctgttgtcagaattcagggatataagtggatagttgtcaaatttattccttttccttggcctcctggaaatagcagatgatttagaaagataaagctgcgctttctgttttgtgccccatcgaggctgtgtaggaattggcgtatccaatacttggtgttaggatctcctttctttttctcacgaagcctaaattaatttttccaaaacagacactgtgaagtgcttaatatcttgaagatattaaggagtctttaaaatgatcatatgattaattttaggaaataccatgttaaaaaaagctaaacagtttttattttttaactgcaggtcttctcatagcctttaatttgcaaaaatgaaatacaaagagttggatataatatacaacgtttttctaactcagctgactacgcaacacttttgtttatagaacatactcttgagatcatatcagtattatcagttaagatgctattatctgtgagttatagacaagctaagagttatggaaaagctaagagttatttacaaaaataaataactctccacctcccagttccagggttgattcagaggctttttggtatcagggcagtggtttgcaatccctgtgcttccgttggcctttctttccttcttccaagatgtctgccatctaccccatatcacgttctcacagggcagcactctcatcagaaggaaggagaagaggagtttctccttcacacgtcttgcattttactgcaggaaaataattcccagaattcgtcactgcagtcgttttcttagatgtcattggccaatctctacatcaatcactggcaaggtgaactggaatctcagcgattggctacagcagttatgattcatttgcagcatcaggcacattgttacctgcacaaaagtaggatttacttaaactggaggaagcagaaaatgcactccagtgttgttacccaatggagtctgctacaaaaggaattcacaggggtccactctgtttgtcagggtgctggtttcctgtcattagttttcattactctctttcatcctacatgtgtgggctcagcaactttgtgaattctggtttgtggaatttgacacagatgatttctctgccaacattgaatctcacaggtcacatcttccatcctaacctatatcctaacttttctacccatcttggcattgtctttgtattttgccttgtgtaatttggactgcactggatatagtctttggtcatatcccctcagcattaggtgtgggcagcaggcatggggcatcgtgcattagtaaccagctcagcccacagatgctgtccatgagcttcctgtcccctacccttccccaaagaagggcatcagccagttactcccaacagtagggtcactcttctcagagaactattgggattacttacatcgctcggttgttacgcacactacacaacagggaaacttgttcattcctccgtcccaaggtttgtcaatctagagtagactgagtgttcttctgagcttgcaattcacattattggctggattcttctggggacatggtcagaggagctcactatggaatctgtgcattaaccactcctgatcctataggctgtatttaccagcttgttctagcatcagcacaggttatggtgatagtcgtacagtgaccatatccaattatcaacatttacctctccagcatctgcaccaacagatggacaaataaacaactaagagagaaataaaatgatcctgggggcctgttgtttccctgaactatctaccagttgagggagattgtatgttcatagggtgggagattccaaagcccacctttctgagcactcataaaatatttgattacaaagggatctttgtgcttgagtggtagatgttggtttgggggctgattaacgagcttagttagaaaactactaggtagccaaatgcatgactgccagattctgttctgtggattcaaatactgatctgcaatatggcaatgtgactctatagtcagcatactaggaagggtggttagggctggtgaagcactggtatggacttaggttcagatcccacttctaaatgctccttagtgtctcaaagctttactttacctatacgtaaaataagaatagctttctcataggattggtgactggataaaacaacttcgttaaagcactgaaaaaaaaaaaaaatgcaggcctgatactcaacaaggtgagctactgttaatacagtgttattcccaataattatttcacttctcttcctcctagaaataccaggcatgagaatacagagaacacatatctactgccaccaaactccccacaaggaaagacaacataaagggcaggctctgtatttgatttcatggtgaagtatttaggagataactccctctcagttaaggttgtttggaatgcaaacaatagagacagattccagctatcttaagcagaaaaggcatgcaaccaggcctcccaggaatcagagcttagaatgggaaagctgcctgaactcaacgtatgtcttgctcatctcctgtctttgtttctgtttatgggtccactctggatttttcttttgataaagactccctctacctttatgcacacatcacaccttctagcccctaagatgtatgttgcatcgctttccaccggtatagggactaaccatcagtgcatcctcgttacaaattcctggaaaaggagcctgattggcttagtctggatcagttgttcactctgggccagttggatctgtccagggaagtggtatgaagcaacacagttgcccagggccaactcttgagggaagacttcattactggggaaaaggagccattgctagctgagtaaataacaccatagatgccgggtgcagtgactcacacctgtcatcccagcactttgggaggccaaggtgggtggatcacctgagatcaggagttggagactagcctagccaacatggtgaaaccccgtctctgctaaaaatacaaaaattagccaggcatggtggcgggcgcctgtagtcccagctactccggaggctgaggcaggagaattgcttgaccccgggaggtggaggttgcagtgagcagagatcatgccactgcactccagtctggtcgacagagggagactgtggggaaaaaaaaaaaaaaaacacgaaaaccaccagatatagatctctgctatgctttcaaaatgtggatatcagctgaacaaaggatcctggaaaatacatgtgctaccaccaactgctagctctgtatttctcaaaatataggacacctaccgcacgtcttactcacagctttcaggcgaacactaactcattaagaaagggggaatcacttagaaagttactcccctttccattgtctctctgtggtttttatgccaatcagaaatgctcagtttaaactaaagtatctttagcagggctgtaacactttctaagctttcttttttaagggaaagggagtgtgcctcaggatgagagcctccagccccagagcatctctttgcactttgaaaacattgtttgcaaaatacactattaagaatcaggggcctggagctacgcctactgagataaaatctagactttgcaacttagcactttgtagccttgtacatgttacttcaatcctctctatgtcaaattcctcacctgtatagtggagataatcattgcacagatttcataagtttgtgtgtgtgtgtgtgtgcatgcgcatgtgtcttcgtgtttgtatttttgcatgcaaaaaaagattaaactaattaatgcatatgaggttgttagaaaagtgtctggaataaaaaaggttcttaattattgttggatattaatggatttttttcattaacttttatgtgtgactgttgatattggtttttcatttaccgtggcaatacaaagtttccttggcacacatcgtattttatgttccatttattgttccacttatttaagttaaaaatgggttgctttaaagataaatattaacttcataatgttacatattgcccgcagttatgacaaagattgtgatactggaatgcaaatgactgagttttttagaaatactgaaatcatggtacccgccttgtgaaagaggttgtagagcagatctgcattatcaatatttaatttgccagttacaagcgagtttctcatttctgctagatatgagagtgatgtggattgcataatgaaaattgctaatgatcttcttggcttaaacccatcgccttcatctggacatcagataatgaaacttcccaactgccttgcaattgagctatcagaatcagagataccttctcccgctgtgtctcacccctctccactttttaaagcccagcttttcattccttagtggctcttacgatagcacggaagaaaatgtaagccccccttctccccaccccttggtgagacctcacaggatccatgagttcttcctgactataattttaggatggttcgttgtagaaatgcctgcttctgttcagttatttattcaagaaatattttttgagcagaaaccgtatgccaatcactgtgctaggcagtagaggtataataatatactaaaacttgcaccactcttattctcttatacctcacagcctagtggaaaagacatgcatttgtcaaataatcattgacaaccattggcaaaaaatgttcaatgtgaaactgatgaatatgagaaacaagagatgctgtgtaaaagggtatgaatagaagaagcttacctgattgaccttcacttatcaaacgtaccagattaatacatactgtcccatctctttataaagcatattggcagatgtgcacagcatcctatgtagtgactgtttggtacaaatttacctttctcttcacccgttgcagtgtctgcttgccaagagtcagttgtatttgttcccagggctgcttctgccagctgcacttttcattgtaattacattagttagtggaatattatgtaaactgatgaaaaatgagtgcagtaagaaaaagagctgtttctatgaaaactaaatgctttggaaacattgtatgaaaacacgattcaaaaattattttgcttagctgtgggtgagaagactgtaaaatattagtggaaaaaagccctcagaaatgtggaaagattctgcagtcagattcttttcaatgtgtcttgacattctcattccactttaatcaaacccagaattgataccatagagttaacaaactttaaactttttctgaaaaaagccagattgtgactattttaggacctgaaggccatagggtctccattgcccccactcgacactgccataatagcacaaaagcagccatagataaaatgaatgattgaggctatgtctcaataaaactttatttacaagaacaggcagtgggccatagttagccaacccctgctggtgactgaaatgttagtgaggtgtatgtgggaaggttaatgagggatttttatcaacagagaaatcattcaaagaaaaggccttagactcacatcaaagatcaataaatgcatgcacgttcatatgttttacattaaaacaaaagcctgaagttatttctatatcactttaaaagtgatttcttgctttaaaggcttccagttaaataccttctgccattctcaaatgaaatggcttttaaagaacagaatagctacaattagggctggaaacacaaaataaaattatgcttatttttatgttccaaccctaatgactcagaaccccatctgtctataatggaagaacaaatttatccttttttattggatcccccagcaagtaatttctgggactccccaaggagggtgacatttccacgtatacatcctggtgcttgtcctatgcaaattgttgttcggctgttccagaattctcccctcacttaagaaaagtctggtaagttccctctctggattgttctgtcctcaaaagcattcctctgtaagcatgaataccattctttgcattaactttccaaatgatcagctaaagccagacttcagtgattagctcaggggttagcagaaatcccaggtaggtggtgacttacagagaaccctcaggattcaggcctgagatcttcatggttgatgagatttcatgtatgttctcctgtgtgtgtgtgtgtgtacgtgcacgtgcacacatacaaggaaaaaactggcagaagtttgcttgctttaatcttacataacgaatggtcccaactttgtgattttctccaagcaaagggagtttgccccaaagtaattagttctctacttctagaagctgcaggaactcaggcaaatgatccccaggggcagcttctctagtaaaataagaaactcataagtacatttaaaatgttttttaaaatgttttttaaatgtcatcttcacaagacctgttccatacagagcttgtatgttctccagtctttgcaagaacattaattgatgaacgcaaggaaatcaacttcttgattgattctgatcaagaaatcagccaactagtcacagattttaatttctccaacttcattgtgaaatatgattaaataaagaagtgtacaggtgtccacttttcttcatttttgatgctgaatcttataattcacatatatgttaattaattctttgagtctccccaggcatttgaacactttatttggagaagactcaaaaaaaagttcacacatttaggatatttggcctaatattcattctccctttcccttgctttaatttagcctattatccccagtcctcatgcccctttccagggaaaatctattcccatttcttgctttatcattaaatctgtatcaaacagctccaagcaaatcgctaataatgctgacattttaatttgtcatagctactcttcatttctatgactgatgcctcagcaaggacttgtcttcctgctctgttcctttgaggtctaaataccatttcaggagaaaaaaaaatacgtgataggcaagggaaatagggcaggaagcaaataaatagggcatctctagttccctccagttgggggtaggaaggggcaagtttcagtgggaatgagtaaggagcaagaaactctcctttcctgatgatgcagacaaacctgagatggtcccaggaaaaatggcaacgaggccgggtgtggtggctcacacctgtaatcccagcactttgggaggctgaggtgggctgatcagcaggtcaggagatcgagactatcctggctaacacggtgaaaccccatctctactaaaaacacacaaaaaattagctgggcatggtggcgggtgcctgcagttccagctactcaggaggctgaggcaggagaatgccgtgaaccgagatcatgaggttgcagtgagccgagatcatgccactgcactccagtctgagagacagagtgagactccatctcaaaaaaaaaaaaaaaaaaaaagaaaagaaaaaaggaaaaatggtaatgagatataaaagctttctgtcttccttcatggccatagttaaaccttatttaccctgtgcttgtatgtggatgaatcatgggtacagcaagcatgtgcttccttgttgtctgcagtatatgcttccttgttgtctgcatccaacagacatttctgcctatggtagctagtactttattattctatttgggttaaatttcctctttcacgtgtgcagtcttggagagaggataaatcacaacacctgtccctagccaacagatgtggatatggccaaggcaggacagttgaattctttctcctgagactctgaatattgagtagggtaatgctaaatatggtgaagaaaacaagcatgattgaaaacctggagttcattcatttcggtagtgatattctggtgaaattgagtgaagagacggttcccagggctagacctcagattcaccctgattcctgcctttatgtttaaccctggttatccatctatccgtcccttaagctacctcatctcattcaaatgatcgccatttttttttttttttttttttttttttttttttttgctgaagttagtcagacctattccttttttctgtgatcgaagaatccctactgatacactggggaaatgtgctaaacttggagaactgcagagccaagagtttggttaaaggtttgctaaaagccaactcttcatcataccctgcaatgcctccctgatgcctctgtgaatcggcgctgactttatgtattgacagctaagagaaaggagctcttggtttagggcacacgcagggctagatgcttacctgaatttgtacatctttttgggtcagttctcagtcatcaagagcaggtaggcacaggaagagaggtctgtgcttcagggtctttggaactctgtccttccctgtaggagtaagatattccccccaaccccaggggaccacccccgtgcccacagataaaggatctgtatcagtatcaaagatatatcagtatcagaggaacttgtgatgttacgggatcatcacatgtctctctgccaacttcttccttctcagagtacccttcaaaggccactgagaatgtttataacaagtgccatttcctcagctctaccccagacctactggatcagattctggagatggacccaagggactatttttaagccatttctcaagtgggaatgagagttgagaatagtacttttcaaatttagctggtaaaatgttttgatgtctcagccttatcctaggaatgctattggcccttcatatctgtaggtttcatatttgcagattcaaccaactgtgcttcaaatatatttagggggaaaaaaaacccaacacacacctgggtctgcacggaacatgtgcagactttttgtcatcattccctaaacattctggataataactgcttacatagcattcgcattgcatcaggtattcaagtaatatagagatgttttaaagtatgtgggtggatgtgcataggttatatgcaaatatcactccattttatatcagagacctcattttatatcagcatccatggactttggtattcgcaggaagtcttgacaccaaggtccatggatatggaggaacaactatactaaattatcatgttatatgggctgagttgtgtcctgacaaaagtcatacatggaagttctagcctctagtaactcagaatgtgactgtacttgaagctaaggtctttaaaaagataagtaagataaaatgagtccataagcgtgggccctaatccagtatgactggtgttctttttttttttttttttttttttctgaggtggagtctcactatgtggcctaggctggagtgcagtggcgtgatctctgctcactgcaacttccgcctcccaggttcaagtaattgtcttgcctcagcctcctgagtagctgggcctacaggcacccgccaccatacccagctaatttttgtatttttagtagagatggggtttcaccatgttgcccaggctggtcttgaacccctgacctcaggtgagctgcctgcctcagcctcccaaagtgttgggtttacaggtgtgagccaccatgcctggctgggtggtgttcttataagaagaggagattaggacatagacacgcacaaagggcaaactacatgacccaaagggagatgatcacctaccagtcaaaggaggatgatctgagaagaaaccaacccccctgacacctgagtcgcagacttctggcctccagcactgtggggaagtaaatttctgttgtttgatttccctggtccacggtactttgttacggtagccctagcaaacgcacatctaaacctcgtgagaatcaaatacattgctactaaaatcaaaagcaaatgaacaaccaactaaccaacaaaaagccccccgaacttgatagttcatcctgatgtgtattggtacctctgatttaattacatattctaaatcctattgcccttttgaaatgcaattttaaactagctgtggtatgatactccctctgtatgtgcattttcttgtttacttaaaaaatagtggactcccttgggggatagagatgatgtccttggctccctgtgtgtcaccaccacatacaacaaatcagatggacgcagcaatcctctattgttcgatatggatggagaaaggaacagatgagtatgtgagtcacagcgtgttacttggtttcatctctggagtttacagcctcctgtgagaccaattctgtatggagacgcatttgtaaccttacctaaatgagcaagcaactggtgtttggaagaatgcattctaatatttcatggtttagtgcccctagcttacttagaaattttgcttctatctagctttcttgtagcgaaggtagaaggtgcccgtgtggtccttttagggatgatctgatggagccgtgtaatctgctttcttcaggtgcacgtctcatcttgaatgccacctttcccctgatacactccacctgcccactcgtgttcagcatcatctccaagcaccctgcctcgttcctctgtccacatgctccatggttttgcatgggtttttctgaacctgcttctgcagcaaagctgccatctatctaagacgctgaccctttttaataccatttttctaaaattgacaaattaaaatggtatatccttattgtatacagcatggtgttttagtatgtgtacattgtgaaatggctaaattgaactaattagcattgcatgacctcacatacttaccttattttttagggtaagaatacttaaaatttacgctctcagcagttttggggaatataatacgctgtgattacctgtagccgccatgttgcacagtagatctgatgaactcattcctcctgtctaagtgaaagtttgtattatttgaccaatatctcctaaatcctccagcctccaagcctctggtaatcaccattctactcttgcttttatgagtttaatttttttagacgctacatggaagtgagttcatggggtacatgtctttctgtgtaaggccctgatccttatgtgtttttcccccacagtaacttgtgtaaaaccctatacccagagaataacaaataaataacaacaaaaaaaaactattaccaattgaaatggtttaattcactccaagggggaaaaaagttttgcaaacatctaagtcacttcagagtgttttgatagtatttgcatgagaatcttaaagcctatagtcattaggcacaaacaaatgctaagcaatgcacatattagtccagagattctctttaattcacacttagagaaaaagggaggttaagagttagaaccatagctaattgtggagctgggaattgaacccaggtctatattcacttgttttgacaaacatggtacgttaccttgatgtctattgagattgccttagctcaaggtaagaatgcatttgctttttagaaaggagctaaaatgatcagtcccattgtgaggctaagatacgagaagggtatggttttctttattgatttggactttggggttagacctagcattgaggcccaacctttgtaggatccaactatgacaggtggaaaatgcctcccctggttagttagaaatttaaatagctaccaaatgagctgagtattttatgtgcaaagttttaggtgctaccagttaaattatttaacatctaccttcttgaccctgactcataaagcggggggtgtttttgttaaaagtgtagacaatttcccaaaactatagcagcaattatagaaatctatgtgttctaatttaaggtccttccacagtcaggactgaagtcactgagtggattggtggttgaaatcatttcttctttgtatgccagggttttccagggagaaaagtgaaagaaaacacaaaggtttggttcaataagaggagcacttgatgtcaactctgtcttcccagccagtgagtggcagaatccttctatttctagccatttacttattttgaacccagaccatttattttctaaaaacagattactcatgtggtagtttatataccaaactgtagaatttttcattccaaagacacatggaaatgcctctttatgctcctaacaaacagtaacagattatgcacacagagcatctactgtaagtaaataataataagttaagctgaagggacacacacagaatctataccaggcatatctgaaggggaactcatatgccagcggcagccttccatgcttgtgacatgggcccggagaactgaacaggtgatcctttcaccaaacccagagggtgatcttgaaaacttaattaaagcagagttcttccaggcagccgaaattattagttcagagttggtactcatgttgaaatctgtgttagttttttattgtggccctaacaaattaccacaaaaaaaatagtggtttatagaacacaaatttactattctgcagttctttaggtcagaatttcaacaagaatctcactgaagtaaaactgaaatgtcgccaaggctgtgtttcttttggaggctctaggagagaatccttttttttttttttatcattctgattgcagtcagagtccaattccctgtagttgtagaactgaggtccctgttttctttttttgttttctttttttattttattatattttaagttttagggtacatgtgcacaatgtttaggttagttacgtatgtatacatgtgccatgttggtgtggtgcacccattaactcatcatttagcattaggtatatctcccaaagctatccctcccccgtccccccaccccacaacaatccccagagtgtgatgttccccttcctgtgtccatgtgttctcattgttcaattcctacctatgagtgagaatatgtgttgtttgattttttgtccttgcgatagtttactgagaatgatgatttccaatttcatccatgtccctacaaaggacatgaactcatcattttttatggctgcatagtattccatggtgtattttactgggtgtgagctgagggtcattcctagtgtctagagggcgccattttttttttttttttttgtaattcatggctccttccttcatctttaaagccagccatggtttcatgaatcactctcatggtttgactctctcgtgcctcttcttctgttgtatctgtcggactggtttctctcctgcttttaagggttcatgtgattacgttgggtccacccagattatccaggataatctccctattttaagatccgtaattataattccattggcaaaatcctgtttgccatgtaccatagcatacatagatctaagatcagccagccaagattgtcggtccaaaatcatgccacactagttatgtagtatccccactctaagtagactgattctccatgtgtattcaaacactgcagacatttgatttgtgttctgggatggtccacctccattttcatataaaatatagaaagtcagagaccagagcattcagaactaccatccaaggtagcccagggtggccattggcccaggactcacctctacctgccttttgaacttcttcttttgcagtccctactggcattcattgcttcaccatttaagtccagctgttacaaaagaagcattgttagaatgtctaccataatagtactgactctttgatactattattattattattatttattattttgagacagagtttcactcttgtttcccaggctggagtgcaatggtgcaatctcagttcattgcaacctctgcccctccgggttcaggagattctcctgtctcagcctcccaagtagctgggattacaggtccctgccaccacacccagctaattttttgtatttttagcagagatggagtttcaccatgttggccaggctggtctcgaactccagacctcaagtggtccacctgccatggcctcccaatgtgctggggtttcaggcatgagccaccgcgcccggcctgatactattttattacttgatagttctgttgatttctactcacgaagtgtgtcaagtaaggtaatgagaatgtagaaatgtaaaattattaaaaccagaagcatttgtatgtgtcacttaagtgctaagtaaaacacatgaatgaatgagtgaatggatgtttctaaagactctaggagatgtctgtagcagatggcatcagatccctgacattattttatcacccactcctttatgtcaaaagctggctatgaaaaacacctatgaacctatatattttttaatcctttaatttatttattttttaattattgttttttaagttccaggatacatgtgcaggatgtgcaggtttgttacataggtaaacatgtgccatggtgttttgctgcacctgtcatcccaccatctaggtattaagccctgcgtgcattagctgttttccctaatgctctccctcccatcagtctccccaaagaggcccggtgtgtgtggttccccttcatgtttctgtgtgttcgttgttcagctcctacttacaagtgagagcatgcggtgttcagttttctgttcctgttttcgttcactgaggataatggcttccagcttcatctatgtccttgcaaaagacatgatagtgtgcttttacactgaacctcttcataagggctatttttctggctatgggacacattcctttcacggcctgggtaagcaagaagcatcatggaattaacaaccctggaaaaagcactcaactgaggataaatggggacttagtggatcgtgccccagcttcctcatgcgctagagtaagtggggcagcatcgaggtgtgttctgccatctcccagagctctacaatgggattaagccccagttgcccatagtgggcacttgctcgttaacaaaaattgtgttcctcctatccatgtctcaatttccattccccattgatgttcccttacatcactccaaaatgtagaatttgcgcttgaattttaccccagctctgctttcagggaaacggaaactaaaatagtacattcgccataatgagaaacaccatagcctaataattccatcaagtaaggttttctgatcagtggatattctcatcatcatccttttgccatcagtcttttatccctcctcctctttttcctctcttgcacagtacatcactgctgttgtaggatgtggattcttggattattgaataggtttgcaagcaactgccgctgtgctcatggtgcatttcccaaaagttaaaaaacttgagtttggctcactgagcgatcagagcacgaggttttgatggcacagtgtcttgctcacatatgaggagactgatgtatttgctgccacattccactcatttatacttgcctcagtgtggtttcttatttgcaggttgcttttaacaatatagatgctttcctggatagagaacatggaggcatgattttggaaaacttgtctgcctcagatgcacccacgcatacacagatatatgcatataccgagtattctgataacaacttagagatttaaatatttttggcaattttgtggtgttattttcaggggttgtatattcttaatcttgattgcatatgtgtcttgacatctttacgccaaaggcatgtttttatagatgtctgaattaaacactgaactcttttcaagatagctgagtttacgtttaagtggttttgattaacctgggtttgcttatttgctcctaaatgttctaatgcagagccatctcccttggcatgaagtgatttgggagcacagctttagtaataatacttttctaagtaggcaagagcatcctgccctgaatgtttcccaaaactggccttaaactgaagaattgaggtttagccatcccccttccccttagccattcaggtggtgcggattgggaaactggaacctaactgcacagacaccaaattgaccaagggtgacaaaaccagcactgacaagactgtggttgttgggtaggtgaagggttcatgagctagtaagcaggactcagcttggaatttggaaaatccttagtgcaagcaattttgcccagagtggcatgttgtcaagttgtcctcaagctacatttgccattaagagaaatgaacttcaaaaaacagcatagcccttcacaagcctatctttactcaaagcctgagaaaggagggtcccatctggcttaacacattacaatttcttcacaagtggagcttctcggctgctaccctgaagcttccgttttgactagtattggttcttaggtatcacagaggaattagattattctaaaagcttttattgagcatatactacatacaccactaggagaatagtaatgtcttgctctcaagggctgtgcattctggtaggtggtgtgaaaaggtaggtatatgtaattataatgccaggaaaaagaaaatgcgatttgttagtcatgaaattaggtgttagaaaagcgcagaggagagtattattacccctcctagcctcctagctgcaggaagtgtggcagatcatttaaaggatatatatgtattacatacatattatattttatgtatctgctaattcttggatttttgaatagatttgaaagcaactacaacttgatcacaaattgttgttggggtcacaactgaccccaacactaatttgcccagatatgtgtgtgtgtgtgtgtgtgtgtgtgtgtgtttgtctgtatacataacctgggtaatttatacatacatacatacatacatatatatatattttcccagtattgaaatactacctgaattctaggtccctatacacaaaaagttactgtttattttaacttaaatatcacttagacatcttaaacttcatatacccaaattcacactcatcatctgtgtcttctacacacacacacctgcccattaatctgctcttcctcccttatcatgtctttttacaacagctcctaattcagttgttgagaccagaagctcagctgttgctcttcactactacatctttttcagctctaccttctcctttagatttgtgattcctaatatctcttaagtctatgaattcctctcaaaattcactctcgcaaacctactcgaagtcataacgatttctaaactagattatttcaatagcattccaactttctgacccgttctctagtctttgttccttttacggtaaacatgtatcttgagctgcctggaacaatagtagttacaactgttgtcctggtataattattaatagcactttcttctttccccagaaagtcctggtttggagaataaattatgatcactgaaccttctattcactccttagggccagaatgacctttaaagagcttaattaatgctactcttattcttcattcatcactttcattacagtgcttatcaccttccttacgcttacccacaatctgttattccctcgtttgttttgtggtttacttggtcatggtttctcgttctcctgtcttcttactccctttagattgactcctcttaagggtaagagaatgcttattttgttcttaactctactctctactgcctataacatagtagaaactaaatattaatacatgtttgcaaataccagtggctattgttttttgttgttaatacaatgaaagaatcagtatgcaccaataacataatctggctacaagataaccgttattctagaaagctgccctaggaagagatttcagaatatttcagaggatcttctgttttttgccatgttagaataacttgtaccataaacaactttaatactggacaaaatatatgaagcatcattttcaggcaatgggtacaaagcagcacagagctgtgatccttcagagaatcggagacatgtgagatgaagctaccgttggcccagttttattcctgggaggaacgtcttgaacataagtgctctgagatgaagaatttacaagttggggatgaggaagtagctggaatttgtggaaccggttgctacagaaaggacagatctgtgtgggaaggagaagtctccatgccctgagttcttggctgaggaataagccacttatgtgcagggtcaggctttgtgagtcctcacagggagggttaactgtgacacagaggccagggtagaggtagtacaggttgtaggtattcagttgagactccagaaagatcagactttaggagtaaagtgtgtatcttagggcaagggtcagcaaattatgctctgcaggcaacatctggctatgggctgtctttgtagtctgtgatcaactaaaatgggttttagatgattaaaacttaataatatgtgactgagactattttacctgcaaagcctaaaatttctactatttggctcttttcagaaaatgtcagccaatcccttccctatatgaaggggcatggcccatgactgtagacaaatcctaagaagatcttcccaacaaagcatgaaaatgagctttacagggtcaagagcatgcatgagttagccgagcgctgccagaacaaaactcaaccaccatttaaagaaagacgatataattcagaccccctacaattcgttctatgtattgaaatccacacaattgaaatgtccaatggtaaatgtccagtaatgataaataccatggctggtgtggaggctcacacgtgtaatcccagcccctttgggaggtcgaggtgagtggagcacttgagcccaagacttcaagaccggcctgggcaccatggcaaaaccccttctctacaaaataataaaaaaaaatatatacaaaaaaaaattacacaggaacggtggcacatgcccttggtaccagttactcagggggctgaggcaggaggattgtttgagcccaagaggtcagagtgagctgtgatttcatgactgcactccagcctgggtgacagagcaaggcattgtctcataaaaataacaaataaataaatactagatgtgtagaaaagaaaaaaaaattgactgacaatccagagcagtgtttggcaagccacagtttatgagacagctccctgtttctgtaaatattcttatttcattggaatatagtcattcctatttgtttccattttgcctatggcttcttttgttttgtaacaagaaggttggacagtttcaacggagaccatatggcccacagagcctacaatatttgttttctgtctcttttaaggaaatgttttgtccactgattaggagaaaaaacagtcagtagaaagggactacaagatgacccaaatgttaggattgaagtagacaaggactttgaaataactgtttgaaatattgtagggtttataggaaaagatggacatgatgagttcgcagatgggaagtctcagaaatcgaatgaaaaccataagcaagaaccaaactgagattctgttaggttgatgcaaaagtaattacggcttttgccattaaaatgataataattaaaataatggcaaaagctgcaattattttgcatcaacctaataaaattgacagtacagtatctgaaatgtaaacatcagattgtaaaatgctgaatacagaaatctgttaacttgaagacagtgaagaatagaactaaggaacaggaagaagaaaaatattgaaaaaaattgaaaaaagcctcagtgatttatgggaaatatcaagcatttaaatacatataattggatttctgaatggagagaagagacagacaatgggacaaaaaaccattttaaggaataaaagctaagattttccaaatttggtgaaaacatcagcttatactccagagagcatggggaaaaacaagcagtataagcataagaaaaaattatacctgaaaacattataaagaaatgcttaaaaccaaagataaacagatgcattttcttttggaaaagagatctatatttgtctattgcgcaacatatctctgtaatgagtacaggtaactaagttctctaaagccatcccccagtgagacattgtgaaaacttctgggattggaaatggtgaggttgggaagaggtaggggagctcattgagagtagaatcaaagggaagtcaaagggtgagaattaaagaaaaagagaaaaaaggggcaaaggaactccccaaagcgtaaaagcaacatacggcaaattcgatagtagccaagatgaagttctgtgttatttgaaatgtgtactcatggggctgaggctgtgcagttgatcttactacagacaagttggttttgttctgttgcataggtacagactgcagtgatgttgcatatatagggaatccacttctgggtaccaacagtaaaagtgcttcattgctcagtgatgatcaaaccgtcttcaaatgcaagcagttattggttttagttaacaattatttatagagcactgagaggttgcccaaaagaactctaggagaagagttgggaagtcaaaaactttcagttgctgtgttgccttgtaacagtgtttgttagcatacatgattaggggaaagaaggataaaacagttgcaagtatttaataatctggaagttttacagaaatatctagattttttttggcttctctttaaaacaataagtattaaaaaataaaagcccacacaactttgggtttgcatttctttttattttttcttttttttatttatttttctttttttatgagacggagtctcgctctgttgcgcaggctggagtgcagtggtgcgatcttggctcactgcaaggtccgcctctcaggttcacaccattctcctgcctcagtctcccgagtagctgggactacaggtgcctgccaccacgctcggctaattttttttatttttagtagagacgggatttcaccgttttagccaggatggtcttgatctcctgacctcgtgatctgcctgcctcagcttcccaaagtgctgggattacaggcgtgagccaccgcgcccggcctgggcttgcatttcaacatgtaaacaatttcctgtaactgaataaccatggctttatttgaatgaggcatactacactttgccaccgtccttgcacttccctattagtcccctaaactgacaccagttgtcagtttctatttatcctcacacttgggctttttttttttttctttttttttcgagacgagtcttgttctattgccaggctggactgccatggcgcgatctcggctcactgcaacctctgcctcccgggttcaagtgattcccctgcctcagcctctcgagtacctagaactacaggtgcactacctgctaattttttgtattttagtagagatggggtttcaccatgttggccaggatggtcttgatctcctgacctcatgatctacctgccttggcctctcaaagtgctgggatttcaggcgtgaaccaccactcccggccatttttttctttatggtagaattaagtagaaatgaaatcatttattttacccgagtctttgtcaaaaccagcaaaagaaaagaccaagaagagtcccatgcttgagaaaaaagttaagaaaataggatataccagatttcttggtggaagtgtaaaatattttcatatgcctaatatacaaaaaataatgccatatcccttctcacttgactcaaatggaacacctgtgggatgcctgcagatacttgaatttcttcaaattactgctttagcaaaactttatttttgcacatgaaatttttttcctcccaataatataccatcatactaacaaaggttaacaacacaaagtgtaaacaattctaaataccaccttcccatttctaaccaagatgttcactcgtaacagtgtatgcataatatgaaatgaccagtttaaacttccattccaatgtcatggtttatatgcccactcatatacctcctgtgagccctggggataatgacacagtttcttgtacaatttaagtggtgtcacctctctggagaccagtgaacagactgctggttgttgtcttagttaaacacttactttctaacaattttctaacattgcatttctgaaacagcttggaaatgtgcagtgttattgggtgtacgcgagagaggtgggcaaagacatccatctgatttcttggaacagggccatttagttagtggacgagacctcagaggttttctttgcacagacttctcctgatgcacttataattttctgcccagaaatctcttcaaggcctgtggagttttagctctgggggaattattcctctgaataagcggtttcccagctgcgcacataatgctccaatcaggctagtctttgttcagacaatccatgaggggaaatgttggcattggtgggcaaggtactgttagccccactgtctcaaagtacatcggtgatgtccatgtgtaactgaccaaagtaaatgcagttttgcaaactgcaatgagttttacgtgatgaattttcctacaaaagtcaaaatgggaaattcaggttagtgtaggtggtgaagctactacatttattagcatcaaaagcacagagtctcaaagacgaactaatctgtgaataactgtgccattagtaagatcataaacatggactaatggggatatggtacagtgaaatgctggtatttgcagcctgtcatcatattagtacaatgatgaaatttgctgctaagttcctcagcaaatgttcagtatcatgtttgtgcctttttgttataatttgtaccgtattagtagcaacttaccatattagtgactttaaaatgtttttaaaattatatctgtcgggttgatagaaatggaatgttctggggttgtgcaagtattagtcgtattaaacttgtcctgttagcagctttcccttgaactgatacttaaatgaggttttgatataaacaaaatgtgcttctgagatgtgcttccagctacaaccaatttctcccagtccattagctactttgtatcccttttaagcaacttgagattgtgcttttattgaggagccaaaatgtttgctcaactcattaggccaaacagagagaaagtaaactcaagggctgtgctgtctcctgagttactctggggcccggtgaatggagcattacctccatcactgctaagacagacaaacaccttttgagattttcctgcctttgcctctctctaccacttgctcctcctcctctttggctcatgagaaaggctggtaactccactgttcattctttctcatctttagtctctggatttcaaaagtcatcgttttcctgcagaagaaggagaaaggagcattgaataggcaaaccagctgatgtccactatacagagttttttggtgttagaaaagctggtttagaaaccaccttaggaagtgacctaacccagaaatggtttatctttgtaaaatggctttctcttgtttataaccaaccccatatactttatttatttatttagatggagtgtcactctatcatccagtctggagtgcagtggcacgatcttggctcactgaaacctccgcctcccggattcaagcggttctcctacctcagtctcccgagtagctgggattataggtgcctgccatcacgcctggctaatttttgtatttttaggagagtcagggttttgccgtgttggccaggctggtctcgaaaccctggcctcaagtgatccacccactttggcctcctgatgtgttgagattacaggcatgagccaccacacccagcccgaccctattttttattttatcttattttatttattttattttatttttttttgagacaggctctcgctctgtcacccaggctggagtgcaatggcatgatctaggctcactgcaacctccacttcccgagttcaagcgattctcctgcctcatcctcccgagtagctgggattagagtaatgtgccaccacgcccagctaatttatatatataccttttttttttttttttttttttttttagtgaagatggggttttaccatgttgtccaggctggtcttgagctcctgacctcgtgatccacccaccttggcctcccaacaagaccctattttcaaatgaggtcatattgtgaggcactgggagttagggtttcaaaatatcttttttggggggaaacatggttcaactcatgacagcctgaagtctttatttacgtgtatctatcccatatggtgtaccattctcaatcagcaggagccatacattgtctgttgctgtaggattataatcagactcactgacttcacttcctatctctgcaccatccaggcgcgggactgcatatgtttattggccaaacccagttttacttgctcatcatacatctggctctgccccaactggagcttgcaaactgagggttgggcaggggaggtttgttaagaggagaccagtgcatgttcctaaaagaaggggagcagaggaaaggtatgctgagcaggtacaacaaagaaaacacagaatgcttcatatggaaagttctgcctgagcagaaccacagtttacactgtgtacctgcattttgtcatgcagcacaagcaagaatagagggagctattcagcaactcacagtccttctttgtcaagttcagattgtaaattcttggagtatttagaggtggtgtcacatctgtttctctccctctgtataaagaaaaataaaatgccatattgaataagtacctcataaagccttttgcgttatgatggagagacagccaggaagatgagagtgaaaagtaaacattttcctgcatggcaaatggaggcttttgagggtgcttgagatgtttaagctcttgtcttgatctaggtggtggttacacagggtggtgtttgtgtgtgtttgtcaaactgtacacttaagatttgtgtgctttaaccccatggttgctagtggctgtagggtgataatgggaagttattattaagtgagtgtagaattccagttttgcaagataagaaaaagttctgtgggtggatggtggtgatggttgcccaacaatgtgaatgtacttaatgcagctgaactatgcatttaaattagttaaaatattaaattcattgtgtatatatatatacatatatatacgtatatatgtatatagatgtatatatatatacatattatatatatacatatatacatatgtatatatgtatatatatataaaaccacaatttaaaaaagactagtatactttactatatcaatattattcctcagccaaaaagtaaaagtaaataaaatgtcccattcccatttgtttttgggagtcacaagaagggttgaactgacctctgatttcatgcagcgtggacaggcaattttagggatctttactgcaatatctcagcagatagctgaacactggcataaatagattatttcctccaatgccttgcctatcattctgtaccttcttcggcttcctaaatcctagcaacaagtaacctgtctttatcctggcagaacggtcttcactatgatttcagtgccaaagtaatgactgtttgtactgaatacatgtaacagagcctcattccttagggaatgtgtgtttttccccttcatgtttgttataaagtttgcagatcaccatccctgtagtcacttaagctctctgacctgttcagagattcctcagcaatttgctctctgggtatccttttttcatggtccatgttctcttggggtacactcacaactttatttttctagctgcatgctgccattttgggattggctgccatatgaaccctgggtgttagggtatgcttcccatcacagatgacattgaatagttcaaccctctccatctctcctcttgcaaggtatcatcatcattcattgcgtggaagaccacaacaaactcttgactggccttttcgctgtcactttgcctcaaggccacaatccatcctcaggaccaagggagcctttgaaataagtcattccctccttgacgttcgttagcagtttctcattgcttgtggagcaaaacacagatagcacctttagtaactaaagctctgcatgaactggtctttacctcacttcccctcctcagcccttgcgagttgctggccgtagccacactggctttattttactttttttgaggcagagtctcactctgtcaccaaggctggagtgcagtggcacgatgttggctcactgcaacctccacctcccaggttgaagcgattctcctgcctcagcctcccaagtagctgagattacaggtgcacaccaccacacccagctaatgtttgtatttttagtggaggcagggtttcgccatgttggctgggctggtcttgaactgctgacctcaagtgatccaccagccttggcctcccaaagtgctgggattataggtgtgagccaccacgcccggcccacactggccttattaacatgcagaacatggtaatagtgttcattctactaaacctgtttgtgtgtttgtgtcctaaactttagctattataacttggccactcctcatgggggaatcaaagggaagctgttcttggctttagagaaattcacctcccaaggctagaaaaatagaagcactcatttctcactaatgatgggaatgagagtagtgggagtttttatatggaggacattatttatgtactttttaaattaatttgttcattgactcagtacaaattgatcatctcactacacctgtgttgtatatctcaagagttgggtagtcaagtgatagttttattattgtctatatttcataattatttattttaaatatttcataatgagtaattttttaaaattatactgatcaccctggccttggtaacatggatgatttgaacacctgcctggagaatccaataataggattgctcttattgatgaactaatatgtttaaccatcttcctgttgaggtcagtctttttagtggcataaatattccttccaggcagtggagtttgggataatgtagtagaaattgctggagtttctcctaaaggagaagaatctgtgcttgctcctgtggccacagagatcacaactggaaatgagcagccacgtggctgaaagtggaagaagcgattgaattcctcccatcctctctggttcatagtgatggtcggtggtaaccaccccaatttgcaggatctgggagaaccactctggagatcactccttggtatcctaattccctgttatctatcttggtaaactccagccttctggttggatattttagctactgcaacattgaagacctatggttcaggatgaatctaccttctcaggagcttcagttgtacagaatacattgtcaagtgatgtcctgtaaacacatattaaatgaaggttccaggctgggcgtggtcgtttctgcctgtaatcccagcactttgggaggccgaggtgggtggatcatttgaggccaggagtttgagaccagcttgggaaacatggcacaaccctgcatctaccaaaaatatcaaaaattagctggatgtggtggcatgcacctgtggtcccagctacttgggaggctgagatgggaggatcgcttgagcctgggaggtggaggttgatcaaacctccacctgggtgacagagtgagaccatgtctcaaaaaaaaaaaaataaaaattaaaaaaagaaggtttcagcactgattcagttgagtttatcaagtcatttttcacatttcgttcagtgtttagtaacacaactgtttaatgaaggcttgcagactttctttcataaagtttaaagttgtatgctgattgctgtatataattaatgtatcacaatggcattcaatttctgtagcagatcagaagccactgaaacagagaggccaccagtagcttaatcagtgttggtttcaggctattgctttgcagttgattaattattgtgttgagttgataactgataactggattaattattttaaaataatttctcttgaagcttgacaacaagagttgtaaatgtttccactgtgaaagcagctctggacctaccagcctgcttgtaaatatggaaaaaaatggttttgaattgaatatttgaatatatttactttgttattaaaatgatttaaaatggaaggttttgggagtgacaataaatagaaaatgtcactctgctcatttcaaggaacaaggtttgaggaattgattgaatcatcaatttggttatgagcagaatttaaaacatagaaataatttgctgacaccccccgaggggacagtccacggaatgttccattccgtctgtttaacctctggactccagagtacagggattgtaacacctcccacacttgattaatgggaaacagctgtctcctgcttgtgtcacagtgataaaatgtttctccatcttagggcgaatctcattccttgcagagggaccacatgttcaagcaggtgggagaatgaatgggtgcaaactgagcagaggcaggaagagcataaccaggggactcatttaggctcacagaagcttaagattaaatataaaaaaacaagaaatgacacataccaatccactggtgtatcagaggccatgaagtatagcctgtgtacacccctcaccgtggatcaaatgggtttctttgttggctttctcagagcttgtaagagaactcagtctgctaactcagatgcacaagaaacaacttattacattattcatttttaatcagtttaattttaaatccagattcttatccctatcaggcaaaatgttcactttcagctatttcactcctttcccttttcctagagatgggcaagagcctgggagaaggtagtgcccagaaggcaccgtgcatgggtcagttgttagtggttgccatggtgacatttgctttcaggtacacatagtgcatcttggcttggtggctcccttggttctctaccatcctgaggaatggtgactctgtggtgaagctaggaaccctatcacttagcatcctgcccacctagaggtaccatgcagctgtttttttcctgggacccagagctgtttgccccgctcacagtcttgataccctgtgacctgttaaaggccctaacactctcctgatcatctttcaggtcatttaccctaatcccacccgggggcttctgatcaaacgtctgcaaagcatgggcaaataaatgtgtgggacagacctggtataatacaatcaaaatatggaaggactgtggtaaacaggagagcatgattcaggtccaaaggcattcagatgcaattaaatataacagaacactgtgctggtcaaatggactatatatgtatatatgtgtgtgtgtgtatagaggtatgaactaatatatatgtatgaaatacatatatacacacacacttatatgtgagggagtagtggaggagggaagaaagaaaaaaatgtggatagaaaaaagcatattaatatttgaacaaataatcttgctatgtacacctcgaagaggaaaaaagaaaatgtgaatttgcatggacctagtaatgtcttacttagagagatccattctttcctttagctgatttcagaaggccacttgtgagaaatagtgccccatgcagcaatgccccaaaagaaaggggaatgtcaaggtgctgcctcataactgacttcagtgactatgtgagaggtataaaggatttcagaggtggtgatacatttcttcaaattgagcttcaaagaccagaggctgattggtctcctgtgctcacttgccctaagtgaaatgaggtttctccgtaatgtagaataggtgacctgtaactctcattgcagaaaatgagcattgagtgaatgtaaaatgtacacacaaccatgatgtgttcatattcccccctctctcatgtctgtctgtatctggcaatcttgtctgtctgtctgtctttctgtctatctatctatccatctatctatcttctatccgtttgtccaaccagccattcagccatccatccatttgtccatccatgcatctattcatctatctatgtatctgtctgtctgtctgtccatccgtccatccatccatgcatcccactaatatgtcagtgtcttactcagaatggaaatactgaagataaagtaggtattatattgtaaaagttctatatgaacgccgtatctaaagttgtgtgtgtgtgtgtgtttgtgtgtgtacttacatctcagatcaaataaagaggctacaaacataaatgcctccaagggccaggcctataaaggaaaattggttattctacttgccaaataacatctgattccatggattgatgcaaactagagaactggaacatgtttgtcacctaaagagaacagctgccactcagcaccggctcatggttatcactttgaaaatgtagaccttaccttgctggatcagccagtacttcaaaaaaaaatatatatgtgcaagttatttgaaatctcttggtttttaaatattggcaaataagttatgtttcaaaaaagtatcgatatattggccaaatgaactgcaccgtcagggtatttgctggcatggatttgaccgattcaccaccactgcatcccgggtgcctccacagagatagatacagagcacgtgttcagtagaatatttgtggaatcaatgaatgaacatatgcctgcaaaattttaaagagtagggtgcttagttatttttccctaagttttcctatcagaaagggcacattttgtccctgtgcaaattgagaatttgtggggatcatgtccggaggtgatctctgtcaccggaaaccataagaaagatgaattttcggttttttcttcactgtaatgacagagtgtgttcagaacttctcccaagtaggagaaagcaatcaatcctggtttgttcagatggtcctggttttagcactgaaaatcctgcatcccaggaaaccgttctgccccatcaaaccaggatggttggtgattcggttcttgatgctctgtgctgtgattcatgggctctaaaatgtactaagcagattggtcagtgtatgtgcctgattgagaacttgtcagttgagggctgtgttgttattttcttacctctctgagatagccagctctgaggctgtctccatcactgcttgttttatggcatggcttggtggtgattctctccatcatgcttagccagtatgcatcttgatgggactacctataggctattttaacaggttactcgccacccgtctcatgctgccaatgattccacagtttacctaatgctttttaattgtttaggttgacattttgccatgcgcagttgtaggtaaaaatttaaatcaacaaggggctcggttaagcagttttctctgtgtgccatgtaaaaatatcactaatggtcaaaactcagacctgagcaagagataatatttccccctctccccttctgtacattgtatgttttaatattaatttcttctttatccatatatcaataattgaacactgcatcaattaatatgctgggcaaattgcattccccatcctctcattcatgatgtgtttcagtaatggagataattttcaagataaagcatacaatttaaaatggattaaaaagaaaaactaataaaggaaaagtgatttatagaaaaaaattatggatactttcaggaaatcttagctgtgcttccaagccgatggattttgtaaggagagcctattgaaacgatcaagttttatgcctgctgcaaaatttcctaggtctgcgattgcaaagagagggagggaagaatgtatacacacacacacacacacactttaaaatttggtcttctaatgagggcgtgtgtatcatcttcatccttagattaggaagccacagattcatgctagcaagtcttcttgaagctttccatttgctgggcttagttggtggggcttggttttttgcttttgatttgctgaattggcacacaggcttctgacggcccatcccccggccctccttcccttttcccggtccacaccctggctgagagccctgcacagagatgggcaggcggcagctgcagcgatgggcaggaccgcagcctctgagcccgcaatgacaccgtggcgtcggtagatggctgtagacaagtgtgctgagctgtgcggtgtgaagagtaatgagtctggggaggccttgacctgactggatgctgcttttatctgaagtacatttaaagagataaaggggaagccgggttgctgcacatgttcttttctctgcggctggagctttactttgagtttaaaaaaattctcagatgctggcctcccagagtcaccggctctgtgcagatgggcttgcctcaagaggatcggccgccttcctgtaaattccaccagtggggcttccgtgaatctcccacccgccatcaggaaatggtgtagtgcctgtctgttgatgatcaacaccatcgctagtattatgaatattgctagtatcatcagtttttgttttcgccactgtggctggccgcctaaagtgtctggatttgctcattaaacagccaaaccaagaatttgttacctaagcaggcttgacagaaaagagaagaagggcaagagttaggaagggaaaagagagagagagaaggagggagagagggagggagggagggggagagagagggagagagagagaggcagccagaagcaagtcacatcacatacagtgccactgaaggaatgttatcctcataaactcataaacaagcacaccaaatcttgtgtaaggaaagaagagggtctctaaggacttgacaggaaaaggcaagattttctacccactgctttcagtttttcttccagatactcttggtgaagtaaggagacttctgtttgctgacagagcccttgatttctctttcaagatgatgatgtatttgtgggtaggtagtgtctcttcctctgtctctctttctctttctctctctctctcgctctctctttctctctgattaataaattgactttggggataaagattgcagcccagagtaatcgcattttgtgtaaggtgattatacttgtggcagaataatcttgcactggtatagtacatgtgctcgcatttccagtgggagttcaggcaagacctggttcattagcattaagctgcaattttattttcagttgcaaaaaggaatgacaaaaaaatgtgtatgtgtatggggtttggggggatgtacggttttctgttttttgaaaacattgatggtggtgaattcagaaaaaaggtctagggaagtcgggttagacatgaagcaaatcctacatcacttgtagctgtgaggtatttcatttaattaccaagaatgaactgctctgagtagtgatggctttgtttatttgttttgtttttgtttctgtttctctctcacaagtgactacttatttgtcattttggggttgagtgctgtagaggagagtagcgtctttcatttgctttaaccagatgtgtgtccgtatgtgtgtatgtgagagtatattttacaagattggtcttgaaaaaggtagatttacatgcacttattctggctttctgataaatactctgtagttgttttttgttgtttttttttctggagatcgtattaaaataagagcaatgaagtggtaacccgtagttatgaattacaatatttaactcttgaagcaagaaaaaaatagtaatctagcatgaatggtttagaaaaaattacttattatgttttgggagacaaatatatatcctagtgtagtttagccaataaagagcatgtgtgaatttcttatgccagtaaccaaagtccttgctctgtgatttcaggtttagagcaggtgttccctgctttgccaagggagggaggcgttttcgaggttcaactcaacctctgtctttcatcagcatcatcatcactgttgtttttcgttgctcggcaggcttagaaaatcctctttatccgcttccctccagtccctgctctggttcaactcagatctatgaactctctttgctgtaaaggaagaaggcctttttgttgaattctttgttaatcacattggttctttgacctctgctggtctctaggtctgccttgcccctcagtgagccttgtcatttacacccttgccccctttctttgggacattttcctttgtagcgactttagctccatttccacccggtttagttttgcacaatttagtacaatgaattctggcagctggagacagagtttattattattttgtcttcatttcagggcaagttttctcttcgagcttgcgtatcacgaaagaggtattttgaaatataaaatcactagttaaaactgcatgaacttaatagagagttctatctaacaacactgaattctcataacatttatttttgacagtggaggttgaagcaattaaaattttgaatgtttacaaatgctgatttttaagcattaaaaaaaagtagtcacgtgggattgtcgcctcaataattaaggaaaaaactatactagcatttcatggaaaggagcctttttggcttttattttgtgaacagattctggttaattataaacaaatatcaataattcctttaggctgtggtgagttggttgctagtcacactctttctctgagttgttaagtagtgtctgtgatattatttatgaagtttgttagctcttacatatgtacatatttgcaactcaaagcagaggaaaaatgatgcgtgtcccagacccccttccacatccgaaaaacttgctgatttgtttcctagtaattaatcttgacttaaaagcagcatccctcaatttctattttcttctctcagaccaatgcattttagggctacatggctttattaactgcatttatcacattgaaaaatgggcactaccttcctttcctgtgctcaagtattctgtttacatctttaattcagattttttttctgcattcaaaaaaaaaatggcagagactttaaattggaacagctggatgcaggctgtttaaggagatatgaattagcaagctagcattaacactgtgaggttggaggggttttccattcttttcttcttcttcttttttaatgcagaggttctgctcttgccttctagtctgtaaataaagatagtctaaatgtggttgatatctctgtttaagagctcatcttgctttaggaaaatgagcctcagctacattgatgtgtgaaaatagtggttgctactgtctcatggatataaaagtgaaaatgaagagacaaggagagacaataaaatagaatccatattcagtttactcctgtcattgtttcttaaatttgtaaagtaacctctttatatgcacctatctgtgttaatagcacacgatttcagtatgtttttactaagatggaaaactttttgctggggggaggtgtggggtagatggtatagtctcccttctctagactgactttgtcattttagtctataaggatggtcctgtgtatttgaaaggtaaagaaatgctttggaatcgtatcaattaaaaatagtgtggccccattaagccagtccaattaaatagttacagatgcttaatatgtccatcatttggtgtcatctcagatttatacatttttttcccttaaatttctttaagaaggttttcctatcaaaaataaattttgtagttttcgttgtattttattttccctgagtgagtacaggttgctgtacaggggaaagaaagttgagttctctgcaaccattggctgacttccgggcggttttgattcaccaaacttggccacggtaggagggggaaacagccttccctacggacttcttggaaaagcagggaagtcacgtttactgaggatgtgatctgagctgagcaccaggctacacttgccgtagaatgaagtaaaaccctcttgaccagcacaacctcccttgaccagcacaaactcctgctctcctgtggttatttaattccgccaggattagaggttctttggaatacaattgagctgtttctcctagggctggaaagtaggcaattggcacctactcatctaattcacaaacaggatacaaattcctctgccactcaagtcttggaccaaatggtccccgcttaaactctactacaataggtatttgtttgactttataaccttttcgtttctctttactttttagttggttgaaacaaataactctttccattttattatttttactcacattttctcatttacattccaagtacacttcctctgtttttactttaagttaaaatactgcaatttttaattttaactttactttttttttttgttacaaatttggtgttccatttattcactgaaaataacttttcttcactttatcgtttcacacttcatcctcaccttttaaaaactttttttttttagaaatatcattttatacaaacatacctgggtttaaaatgggagaagagcaacaagtcaagtcaagaatttctgagggatgttgaaaagacggggagagagttatgccaggcggcagcatctctccttttaccaatgtagttcagtcacttaaaaaaaaaaagaagaaaacgaaaatgcatcattttttctacaggatcctgagagtcctctacctcccagagtgtgttacacttggcagaaactccaccacccagacagctccagttctcagcctgctgtaagcaaacttgtgaagtagctgcctgtggcttatctctgctctttcaccccatcctcagtactgggggagcctcctctgaattctgcattttctttcctgaatgctaaagctttttctgatctgtactctacattctagagcttcgttattaactgagtatagagatggcctgatttgtagattctatgtggatcagagattatgcagaagttgcagatatagagttgctttattgtcttggatcatcatgccagtttaatttaaggtctttcaggacagaaacaacatctgcccattttgtttgacattctcttttcccctttatttcaaacaatacacgtgccctttgtagtaaaattagtcaatgagaaaaaaaataaatagcaccacctcttctagcacctaagatatatgctggaacactggttaaactcttaaagatatttaaagacatcttaaagatgtttttataacatgcacacacacccttcttttctcaatttgaatatagcattgattacaaagttacaaggtataccactgttttattagtagggtttgttgttgtttgtttctcttgtttgtttctgctttagtgtgtgtttgtggagagccagaaatgctatcgcattaaaagcctgtatcaattgtaaaacacatctccatttcagatacattaaaatgtgaagaaggaaaaacaaagcctctgagaggaaatactctgtttcaaaaaatgagatcacactgctttagaacttactgttttgtaacctgcttttatcacttaacattttgtaccattcaatatttttccacaacagcctctttaatactgtatagacagtgttccagcgaatggcgattccagaacttatttaaccaattctttgattatcagttgtttctgcttataaaaatccttgctagttcctggtatggtgtgaatgcattcactaatcatatatgtatttgttcagtgggttggttattgacagagcctttacggacttgggcactgtctatggtactgcgccttgggggacgcacagttaagttaaaagtatgttaaaaggtatgaagagctgaaaacagaggattgcttgttaatattaatcacctgttgattgcagttcacaagtttggtaattattttttcttcaagtattctgtcccctttaccaaatcgaaggctgggacatccgccttttcacagtgattcttctttccgccttggtgcactggaggcctaagtgtcatctgtttttttccaagttagttgacgcattcgttgaatggttccttttcgtaggaacttgtgctggaaattgcctctggcagtcaaaggaaacatttttgttttggagagagaaattttcgttttttattccaaagttcagcatttctgtgtttcctatgagtgcagtgctttacagcaaaatgcctcaggaatacaaagatgacttcttttaccccagtgaattctgattcagaaattcgtttctgttgacctggcaagttcattcagcacccatactggtcaccgtgtatctcagttagggggctgagaaaatggcccagcagactctgattactgtgatgaaggtgttcattatattatcccttatctttcttgactgtgatgtatactgagcttgcctctcttgtctgtgtcaccaggagatagttcagagccctgaatgttctctgttgtctcgaatattccagccgccatgtttttcttgcatacccagcccacttcttctttgacactctgacatagtcacatctttaatgttgcttaaagatgtttttgaacatttggaaagggctagtttcccagcatctttaagtcagaggtacccacttatccagatactcttcaggcagaggaatgatgatggaccctcatgaacatctcaaacttctcgttgattagagggaaactggatggatcgaaagttaatgaatgggagctcatttgtgacttacatcttccccctctagcttaaccattcatggcctccccactcactgcagactttgtctggcagagggagtaatacgctattttccgcttgagcacccagaagctgttgatgtaaattgatcagtacttttttgtgttttcctgaaattctgtttacatgcacatttcctctttgtctgtaaagtgatttgtatcataaagccacatccattttttcccactgtaataatgacacaaaactcattgaatatttgtgtttaaagattcttggaaaacataatggtgtgactatataaggcgtatataatttttttaaacaaaacctggtgagtattaataaaaacaatgatgttgtctttatgattgtgttttaaacatagtaattggtcaagtggatgttgcttagtgccagaggatcagagcaaaacatactagatgtgaaatagcccttctcttcttcattttacattttgagtggtgtttcacttacctttagaaaattttccaaaccttcagacaaatacttgatcaaatgatgcgggtttgaaagacataagcaaattagtttctgtgcaaacttgtgtccccattcagagaagaacaaattgaaaaattgatattcaataccaacaagataatttcgggaagcaatagagcattgttttgaccactaaggaacatgaagcttttaggagaagtagagagagctttgcccattgtcttccatttattatccgaagacattccaggtgaaaaaaaacatgggaaggaaaggtaggaagagaaagctttgaaaatgatttggagacatgcaatgctatttcaagtggttctggggactggatagaatacatcattgctttctttgcattcctatgtcatcttctcctgatgttatcattcgaagtcagactgtcaaatcctgtgtattgggaaacactctttgttcccttgacttggggactcctgcatttcttttgaagttttttttttttttttttaaatcattacattgttcaccctactccaatgtcttgttagtggttgggtggtatggctaagatggctgatgaactgaaataagggcagactgtacagctgtgtgtgtgtgtgtgtgtgtgtgtgtgtgtgggtgtgtgtgtgtgttgagagagagagagattgagacagagggtaagagaatttttctgcttacatttaaataactcacttatggataacatttggataacgtgttctctttaatcacacagacttttgccccgtctcttaatacctgtagaacaaatattgtatctgtaaacatctattgtaaacatcagtgtaaacatcaaaggtaaacatcaattgtggaataacctttttactcttacagagtgatttgcaattctgttatttgcaaatctgtctatattttgttgatgatattagtaatttgttttaactagaatgttctttctttctttcttttttctttttcttttgagatggagacccactctgttgcccaggctggagtttcactctgtcgcccacgctggagtgcagtggcacgatctcagctcactgcaacctccgcctcccaggttcaaacgattctcctgcctcagcctacccaagtagctgagattacaggctgtcaccactgtgcctggttcatttttgtatttttagtagagactgggtttcactatattggccaggctggtctcgaactcctgacctcaggtaatcgacctgcctcagcctcccacagtgctgggattacagtcatgagtcactgcggccagcttagaatgttcttccttaatagaactcatgacaaaatgaaaacatgcttaatttttatctgtgatgtggagttgtgtgtcctcttttccacttggttgtttcttttctcttactttgagttacattgtgagccctttcacacaaagaagggtctgagctttctctatacttggatgtcatgatacataccaggtgggagcttggaatgtgtttacagatgataatcatgttggtaaggtcttggttgatcactcgataagtagcaatttgttttttaattcatttccttgttaagaaaatatggagctgggcatggtggctcacgcctgtaatcccagcacttcgggagaccgatcatgaggtcaggagatcgagaccatcctggctaacacggtgaaacaccttctgtactaaaaatacaaaaaaattagccaggcgtggtggcgggtgtctgtaatcccagctacttgggaggctgaggcaggagaatggcatgaacccaggaggcggagcttgcagtgagctgagatcgcaccactgcactccagcctgggcaacagagtgagactctgtctcaaaaaaaaaaaaaaaaagaaaagaaaagaaaaaataaaacatggagagcatctaatgcatgagatattgtgtgtgctaagttctgacgacccaggagacatgatatgatcccaatcttcatataacttacatgtagtgaaggagacagataaaacacaacacaataacaaaactggtaaccatcgagcaaaagtagtcgataaaagtgttattgctaaaactcatggttgcagagctaagtggagactcaaaggggatatgtaggctgagatatctgagaagtccaaagatgacaggcagtcagaaccaggtggatgcagatcatctcaccatgtcatggaaactctgactcaatttctcggacctatttttctccgtgtcccccagcaggatgtctgaggcaaccactagtagcttctggctgacatgccactgttaacagcagccctggtgggtggaccacactcatccaagaagtagtaggctctaggaaaagttttgaggccaattttcttgcacctggattgaattccttacctacccctgaacccatccctgatactcaacatccaaccctgtgtaaaatatttgctgtttggatctaggagtggacttagccccagtaaaacggggactgagttgagcaggttggctcatgcctgtaatcccagcactttgggaggctgacgcaggtatatcacctgaggtcaggtgtttgagaccagcctggctaacatggtgaaaatctatctctagtaaaaatacaaaaattagttgggagtgatggctctcccctgtaatcccagctacgtagggggctgaggtaagagaatcacttgaacccgggaggcggaggttgcagttggccgagatcgtaccactgcactctagcttgggtgacagagcgagactccatctcaaaaaaaaaaaaaaaaaaaaaggactgagaatagggaagtggtggtttcccaggaaatattaaagagctgttaccagaaagcgaaatgaatcctggtttggtaaaaacaacagatgcctcctatacaaataaacacatgtgatcatttgcaaggagatctaggacaaaaacaaaaaatgtgcttgggaaatgcaaccgcgagagaggtattgtgaatggtgacttcgagcaagacttttccaagaaggtgtcttctcagctaggacctgagagttaggaaactgctatgaggtaggaggatgctagggaggtgtggtggttagaaggccattgtgtacgtggaaattccaggaggctaggctggctcagcctcagatgtgaggagtatggtcagagagagagagagttctgagacaggcaggaatcagagcctggtagattagagttgcttgcatcaaccccagtatcaaagatccccatctcccatgcaacaccctggcattaaagcagggaaagagagaagaaccctacagaggaggacagtaagagagtgagtggagttttcttttctgttttaattgagaagtgttagagaattgtggaatcatttctttctaggattttaagcacctctccatctgcctcaaataatcaaattccatccaattagatgctgttgccactcataatatgcaagtctacatatgtactaaacccagggcctctctgcatctggttttgatctatattttcaaagaaacctgctccccaaacttgcacaatgattccttcacagatgctgagtcagcagagagctagtgcatatttatccagagattctgatgaaaagagggagaaagaaaaatctaaaagcagaaaaatacgaagtatatggaaattttgaggtttcctgctgagttagggagaaggggttggggaatccttgaataaatcatagtgcctcacacaatggcctgctttgtctagtaaaagcacttttggttgaggatcagaaatacaaaacagtttaataatagtgagtgttgtgaggagtttcaagaatcttcgagggcatttgacttaaatgagctcagtgatggagtattcaagtaaagccagtgttgtcaatatgctaacttaaaaggctaatcaaacaggcaagtggtacaagtgaggaaaggaacacaattagttaatggaagatggagggtaatatggaagggacaaaaagttttttatttttatttatttatttagagacagagtctagctctgtcatccaagctagagtgcagtggcacgatcttggcccattacaacctccgccttcctggttcaagccattctcctctctcagccaccagagtagctgagattacaggtgtgcatcgccatgcctggctaatttttatatttttagtggagatggggtttcgccattttagccaggctggcctcaaactcctgacctcaagtgatccacctgcctaggcctcccaaagtgctgagattacaggcatgagctactgtgccaggtaggcaaaaactcttattctattcattcatttgtaaaattaagccaaagatagcatactttactttattgaaatgtaacacacacacatcagcacccttaaacatatacattcggttataatgtattggtaataacacaggaaattcattggtttcttatggggatataggacattagagtggttaaaatagtgatgatcttggctgggtggtggctcatgcctgtaatcctggcagttttggaaactgaggcaggaggatcatttgagctcaggagtttgagaccagcctgggcaacatagtgagaccctgtgtctatctttaaaataaataaataaataataattaaaatcgtggtctttctagtgaggcacagctatattcaaaatttggtccttatcctattttttgcagtaaccctcagtttcttcatctttaaaatgggactgttactagtgcctgaggttgtttttcaactgatattgagctggttgcttatagccattggtctttttgattgatggctgcctctttttggtgggtcagtgtccaaactctctcttgttaaatagttcacaaactatccttgcatagtatctttctcaaacagttatggtgaaagtttatattgcaaaaatagtacttagaatcagagatggcagatagtagctgtttactaaaagttagttgtaaccatcaatactgttgtcattacaaaaaaactgagtacaaacaatgtcttctgcatacgtgtggatgtagaatgagggagggtagatacagggcaggagagatcactctagctgcagtgggaaatggctcaaaaaccaaggaatttcgtaattcctggctggtgtaaactcattttgtaccagcttctcctcgtaggatctttcttgggtgttttatttaacccctctttaaaatggggctaataccagaaggggaatgggatgaaataatagaaccatatttagtgtctagctgagtggtttgcactggtatgtgagactttatattcttctcttctcctattacttataaaccaacaagtatctgagacaagtctcagtcaacttagaaaggttattttgctgaggttaaggttgcacccttgacacagcctcaggaggtcctgaggacacgtgcccaaggtggttggggtatagcttgcttttatacatttagggagacatgagacatcaatcaatacatgtaagatttgcattggttctacctggaagggagggacacttcaaggaggaaggtgtttccaggtcataggtagatttacacatattctgatgggcaagtggttcgtagagttaccgggagaaaagaatgtgtgggtttcaataaagggttatggagacctaggttttatcgtgcggttacagcctctaagtagcaggttttagggagaatagactgtaaatgtttcttatcagacttaaagtttgtgttgatggtaatggtggagaggggtataatgaggcatgttcacccctcagttctcatcatggtctgaaccagtctttcaggttaaactttagattgccctggtcgaggagggggtcctttcacatgatggggggtgagggtggtcaccttcaaattttatttttgatttacatactaaataaagctctctggtgaagggaacaaaaaaaaaagctttagagagggatgcagagaaaacaaaattgaagttgaaaggaatttcgaaatttgtgtgttaaaggaatgactattcagtgctgatatcagtgttgtgaaaaatggttagaataaaatgctcatgaaaatttctctttttaaaaagaaccctgactctttctgaaaataaaagtcatatttggacattatgaaaaaatttgctatatgaagtagaatctgactccccccagcctatcactcatcactcaacatttttgacgtatttcctcctcttttaaaatatcagtatatttgaattttcatagatacccattttcctccaaaacagaatcatactataaacatattttcatacaaattatctcataaacattttctagtgttactgatggtttgggaaaacatgggtttttaaaggttgttttttttttttttttttttagcatatggctatactgtagcttatttacccatttgcctactgttggatgtcaggtttttcttgacatagcctgtgataaatattaatgaaatgaacaataacaactttaaaaatgtacaaaatggacaagggagagtgaacagaggactcagagggggaaaaaagatccaatggccgtaaatataggacactgtgttcaccctctccaatgtcagatgaatgcaaactaaaaatgtgttgtcaaattgagaaatgttttgcaaagggcaatactatactgaatgcttgtgaagttaaactgctaaacatttttagaggttgctttgcaagtacaagggattttttttaagtgaaagtgattgtactttatagcctcatcaaggattattttttgaggaaacactcagagatatagtgaaaaaatgttgcatacaaggatatatggtacaaagttacctatatacactaaaacatctctcaagttttcattcaaagaataaaagctagtattctcatgctatggtacttttaaggcactaaacgatgcctgccgttggttgctgagtattaatttagtcagagctatgcatgcaggcagagctggcctatgcaggccccatttttgtgactaggaatttattctgcaccagcgtggcatagagagaaaccgagtgagtgcagtgccagctcgccgctagcttggatgaatacatgacacaccattgcgcttggagaaaatgctattcattgaaaataaaagggaatttaggaagaaatgtaatactcatcagtaattgcaaggaaactcttggatttcgttccagagtcttggtaatagtggttacataatatagcagtgaatgtatgcgtgagattagagaattttagaaggaagaaactgagattcagaaagagaccggctgtaccaaagtgtatccaaccaaaagcattcacagagagggggcagatcacatattgaacagtggtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaaaaaatgcaacactctgtttctgaaaagtgtgggtgctttccaagctgtcggaccaaagtattactgaaagttattccatttgaggatttgcacatttctttccaagttgtgatttttaaagaggggataaaaaaccaatgacctcattcttttgcatttgtatcaactttgatttccagaactttaactgttttgagtttatgacgtgtccagtctcaagtcagtatagcaatgagtaatcattgtagaattgcctattaaggggcaggcatcgttcctgatgctggaataaaatagcaaatgaagctggcctggcccatttctacacagaacctacatactagctaggaagcagaaggccaccttcagtcctgctgaatttagaaatacagtatatgaattggtatgaaaagacgttcacaatgtattggtatgttaagagatgatcagtgacaaaagctgtgtatcaaatgtatagatagattgataatctacacaccaagatgctaaaagtgattagtttgaatgatttctcttcttcacctctctgcagtttatagttttttgttaagtacatgtcttgtttacataataaaaatgacttaaagaaacgtaaataataacgaatatgcctcatacaggacaaactaagcaacaagtctggtggtatcagaatttgtacagaaaaacctctaaggtacccagcaatatgtcagaaattaccagactcgtgacttcaagtgcctttaactcttagtcatgagaaagtactattacctagtgataccatttgcaaaagaacacacaaacagatgtttctgttgtttagctgagtctctctttcaaacatccatggacaattgaaatcttccaagtatccgttggtttacacaacttgctccctattattaacaacaagagtaaaatagaatttaaattttgttttgtgtttttccacatataaaatctaaaatagttcgttactaaaagcaatcctgcaatcccacagatgtcagaatagtaatttaagaaatatgtacctatctgtatctgtatggaaattaaggccaagataagtaataacaaagtagcattgatttgttaaatgtctttgctagtgactgctgtctggaactactgaaaactgcagtattaacctctaaattgtatccctgagaccctcttcacactcacacccattcactggaattgaggatataagacagtcctgttagttgatgtaacttctcctaagggggaccagtgtagcttgaacatctacttaatcagtctggtacctcatccccatcaggacagtatgcccctctgattaaaacagactattgtcatcctgagatggagggaaattgattctaattcatggacaaggaaagagtaaaatttaaaaacataatctattcaagatcctgactttaaaagcaatggcttacctaagattacgcaaataatttatgataaaggtgggctgaaaatgttgggcttctatagtcaagtcaggacctcttgctgtgatattgctaactcctcagcctgggtatttacatcgggacaccagaaagacacatgttttcctgttggttacatattcatggtcagtggagttaaggacaattaaccaaggaactctaatgttcattttcttcaaccacttcatcctttcttgagtattgctctaccttttttgttgtgacttgcaaaaataaccaacacaaagaggctcagacaaaacacattcttcaagggagaactcactggtgtacaaaacagaaaagtccaagagatggatctcaggtacagccccaaccatattcagaaaatatactcagaaatctctgtgcttgtgtgtgtgtgcacgtgcttctgtgcttgtgtgtgtgtctttatgtttctcagctctgctttctttgattcagtcacagaaaagcccttcttggcacctacagatctccacttacattcttctagctgagccctttgagctgaaagagagcacctctgccactaaagcttggatgtttaagcaaaagtctcaggactgcctgtcattgcttcagcttaaagtataggcccatccattaaccagtcacattggcttggcagtagtctatggagattggccaggtctgggtcacatggcaacctatggaggccaatccttaatctttttctctggaaccatatggtctgattttttttttttttttttggcttcacctattttcttttttcttagttttttattttcataggtttcggggaacgggtggtgtttggttacatgaataagttcttcagtggtgatttgtgagattttggtacacccatcactcaagcagtatacactgcacccaatttgtagtcttttatcccttactgcacttccaccctttcccctgagtccacaaagtccattgtgtcattcttatgcctttgcttcctcatagcttagctcccacttacgagtgagaacatacaacgtttggttttgcattcctgagttagtctgcaatctcatccaggttgctgcgaatgccattgacccattcctttttatggctgagtcatattccatcatatctatctgtctatctctctatatatatctatctatatatggagatatataggtagatatatagattcagtcacagagatatatatctatatatctatgtagatgtatatagagatagatagatagagatatcacaggttctttatccactcatttgattgatgggcatttgcgttggaggaaccatctgatctgagaatggaggaggtattgtttcactcaggagaggtatacgtagacaatagatgctaaggaaggaaagcaattgttctttgtccagtctttgtctgtgctaatgacaactctatgaaactactcagtccaggaggatttcttacagcacaactctctggtgttcatgggactgacagttctggaatatttaaaactattcagtacccccacctcctgtcttgaattcctccttgtcctttgaaactcctttaccgtgaatctatagcagcatcatgacctgtgaagacacagtgcactttgagttcatttttcctgtgggctcttttttgttttcgtgtgtcaggttcataatgactgtgtgtgcatgaatgtgtgcatgagcatgtgtgtaaacacatacgtgagtttccatctctagaaattactgtcattcatcctggtcagagaatgtacagctttgtttaattaaatggtgaagctagttgagaattggcaaatggagtcagattgaaaaatattttacagctctttattcttcattttgtatttcttgtgttaaacagagaaagaaaaaaacacccttgggattgtaagtgatgaacttaagtctttgggattcctttataattcagtaggtcattaattctgcactacttgttgccttttggcttaaacatttgtgttttctatgtgcttagggacttctttttaatcttttagatatctgtctatctcaaggtcctggcataataataataattttatttcttgtgtaatgatttgatttaattcaaacattgtggaaatcctacgatgtgtgagctccatgctaggtgcttgagatatgaattcatgacacataatccctgccaccaagaagcacaaaatttttaaggagaattagagagtgacgtgaccagatgccctaaaaggtgtctgctggacagcattaaacagatacacaagcaaacaaaatagtatattaattaattcatgaaacaagtatttatcatgcaccagacactattcttggcagtgggcatgcaacaaggaggacatggacacgtccctaatcctacgaagcttgcattcccatgtaagccacacagttaaaacacacacacacacacacacacactaaatgaacaaatgcataattgcagcctgtggtaagtgctatgatgtcaggaaatacttctataaggaactgatatttaagcctgtttcgaaagttgggaggaccaactatgcaaagagtcagaatgcaagaacattgtatccagggagaacagaaagtgcaaagccatcgaggctgagagagattgctgggttcaaagactgagtggctggtgggtattaaacctgtgggagatcagcacactgtgagctggagagcaatgtggaaacctttattcagggatgtaaatgccttctggggcagacagacagtagatattctcatctaatgcagcatattctggggtattattagctcaaactggaagggggccactctagggtggaggctggacctcaccttaggattcctcgattcttgtacaacactcctctccttactcaggaggctttattttcttaaacacagctttattgaggaaggattaactgtacatatgtaaagtgtacattttgataacttgacttctgtgcatacctgacaaacttgactgtaatcaaggtagtgaacatctgtcaccccagaagcttcttcctacgtcgctgacatccttctttccgctcctccccttccaccctccccaaaacaaccaccaatccactttctatttctacacactagtttgccttttctagaattttatataaatggaatcatagaggaggtggagttactttttatagcttttaagcccacacagaataaaagtattctaatcttttttccatatgtctttttgtgtctgaaaaggatcttaaacatctctaacaataacctccttgttttctctacccgtggtctaaaacctgtgtttgcttgatgctaaacggtggagggatttttctgacttgaaaaaggcagagtttacctctccttttcttatctccattattattttgaaaaatgcaattgacctaggaaagaaaaagggggatgacagtgacataagattgggggggagagggtagagaggtgaaaggatgaatcaagcaaagatgctgcttcatcgttctgatcccagaaattagatgtgtggatgaccaattttcagctaattagcataaaacaaaatacatttcaggaaaattgtgctcgacacaatttaatctctgatggttcagaacagtctctgggtcatcatgagcatcagctctggaatcagaagcactggggagaaggattaatggggaactggtattcagggagctcaacatatatgctcacaatctccccattaacaaacaagaacttctttctattttatttcagtacagcttgtcctttgtttgcttcctgaataatttgaaaacatgtacaagttgaagtgtaatgcaatataagactttcagatattaaacattacatagtttaggtatacaattgattcatccattcattgatctggtaaacatttattaaacatgtactgtctccaggatatgtttctaggtactgagtatatggtggtgcagaaggtgattctgtatgtgcctgtaattgtttgtgtttgcgtatggttcagtgggatttgttagagatatgattaattgcttgtaaaataggaaagtctaccctgagcataggagtttaaagcaatgcaacaattttgcaacatccaccacagttaaaagtgtccatactctttgatcctctgatagcactagtggaaatttatcttggagatacactcacccctgtgctcaaagatgcatgtattacgaggctcatgaaggcttgtttgttgtacctaaatccccgtcaaggatggactagtgaaacgagtcatgatatatatttatggttgaatactatgcatctgtgaaaagaaggaggttggtttgtctgtactgacattcaacaaactcagacatatggtcaaggaggagaaaagcatgaagcataacgttatgtgtggtaggtttgcatttgtcaatgggatggaaaagagggcagtatacgtgcagcataggaaaatacaagacactgctaacttctgaaaatttattgatgagcaggggagtgaggatggaaaaagagccacctctttgaattactttaaatatttccaaggtgaatgtactggattttcagttttggaaagctaatcttaaaagtggaaaaatagataaaacaagtataaaggataccagtagattttctaatgttaaccttgggacctcatatattattggatgcaaacgtctacaaaggttgctattctgtcccccttctcccttgaccatgccgtgaaacaaagagaaaatgaacaaatccctgcaaccaaaccctctcaccagatttgactactgccaatgagattattgagttaccaactgcctctcagaaccctaaggcaatttggagcccagaaggaaagtgaggcccccaggtggatgtatggaaggaaggtggtgcacctttgggcccttgtgatccaggtgagtgacagagtgactcacctaaaaagagagggaggtctctgcagttggaagctgcaaatgatgatggtagaattttgcacaacccagggatcacaagcccagttttaggggaaagggctctaagagtagagacatccatataggcgcagatagtcctcctttatttaaatacaccagcagctgcaaggagtaaagggtcttgaggtggaaaagaagaggggtcattccagatccaaaaaatcgagatgactcctttgagcaatttcattcactcgtttgctgaacaaacctgaattgacaccttcttggcacagccttgcactacgtgatgaggtgaggtgctaggaccaggtcactagcattcactgaacttttcatttcatgcaagggaaagagccccctatcaggtaatctcacagacaaatatacaattaaaaactgtgataggggttattaaggacactgcagagtaaaacaaacaagcctgattatcttacagggaggaggagttataattcacctgtttatttagaaacctgctaatactaatcactaagaatctctgtgtggtggctcaggcatgtattcccagcacattgggaggctttggaaggaggattgtttgaggccaggagtgtgagaccagcctgggcaacatagcgagaccccccgtgtctcaaaaaaaaaaaaaaaaagaaaaaatagccaggtgtggcaccaccctcgtgtagtcccagcttctcggggaggctgaggcagaaggatccccggaacctaggagtttcaggctgtggtgaactatgatcatgccactgcactccagcttgggtgacagagcaagatcctgactcttaaaaaaaagatcgttcccactttacagttgactacattgaggggttgaaagatgaatttgcttgcaaaacacagcaaatatgagtggagacaagacttcagccaattaacacagggctccggcttaaggagagcctgagcacagtagttgcatagttggttattttaacaataaaatctaagaacttcgagtacacagtggctaatagctaggagggatctctgggcacgaagattagtgtagttgctctggtgacatttggcatattaacatgagacatgaagaaacctaaaccatattcattcaccatagttaaatgaggcaggagtcaacaaaatacagcctggcattaatagcctaaaaacaagatttttgagtttttcttaaaattgtgcacgtaatattacaaagtggtcatgtcacaggagaaaattttagtgactaaaggctggaatgtctgtctatatttattctagtatataactggtaaagaatatgtgttccctcccatcccagggtcagctgtgatatagaattaagatttttaactttgggtagtaaaaggacaccagggcatccatgctctccctgaaattgtgtatcgtacagtatttctggaaagaagtcttcatttgtttgttgtttttttctcctagaagggcatggcacacacacacataaaggttaagaaaaaatactgtttttgaaaagccaaataactgtggttcactatgtcgagacatgtggccaatctcattttcctacagatgttgttggacataaattgatgatttcaagaagcaaaaagaatattctgcaatgctcagtattaaggagttcagtgtgatcagatgggcctttgtcaaactgaagtattttaattaacttacaccgtaaaagtgaaagtgtaaagctttgcttttcttcctagctaatcaatgaagattaatattctatgggaacccgactttgcagacggagctgagcggcactgttttccctaccattttttcctcatagtaaataaatcatttttattatactgtatgaatttacttagctcttttaatagcctttgtaagaataatgcttcctttgattatattacatttttaaatgagtgcagtgtggaatacagttctgctgttgggggaagggtggtgagaaaaggaaagagatactgattatatcagttttatcagcttatcctgtgtgttttaaaccagataaagcagtgtctgagtatcctgggagtcttaggagtaaattactaagtatttgctaggattgaaatggctcatacctgtgccttgtataaaactacttctggggaagatgaggttagtctgaaaggacctggtctttataaaattattctgattgttattttgtacttttttttttttatcttcaaggttctggccaatctatttgattttttttcccccaaaggagagaagtaaactttataattccagggctaacatccacttgtataaattgatcagttgaattgaaaagctgctgactggctgatttagcatgttcttcaagtggtctcattcacaattgataagctgacttgtcaccctgaattattggaggcttaacccttgaaggacagatacagtttggcctatacagattgtacttttcatgagacaggaaaagggaggaagggaggtaagtgtgtgtgtgagagagataaattaatttcattagaaacaaaaatatcctgtgatcttatgcgttagaccaagtgttgaaatattaaagttcctgatgagaaaattcagaatcatacaaactttgtttttctatgtcatccatcttgtacatagtcagcaaaccaattcatttttttgagatggggtctgtcttccaggctggagtgcagtggtgcaatctcggctcactgcaacctccaccttttgggttcaagtgatcctccagcctcagactccaaagtatctgggactacaggcacatgccaccacacctggctaattttttgtatttttttttttttttgtagagacgtggtttcgccatgttggccaggctgaactcctggcctcaagttgtccgcccgcctcagcctcccaaagatttgggattacaggcatgagccaccgtgcccagcctaacaaacattcttttaacatatattgtccatcaagtcagaacctttaatagctcctattcagaacctataatagctccacactgtttatggaaaataaataatggctgaggctgaaaatttaaggttatcttaaatgcagcctcaatatgtaaactctgtgtgtgtgtgtgggtgtgggtgtgtctctctgtctgtctgtccgcaaatgggtcaaagtgaaaagctcttgtgaccttgattcacaagactcaggtttgagcttcatttctgcagtttgttagttgtgtgcttactcatctgttctaggcctctgttttatgatttgggtaacaggaatattagtaatgacagcaataatggggatgactgggctataatgctacttacctaatttaactgatgttttctggaaagaatgaaatcagaaagcatatctgcaagtgctggcaccctctgtaaggcgctgccgaattggttggttgttcttacatgaattcaggggtgagtcagacccatcgaactggagtcagagaaagccttgcaacctggacagaatggaaaattaatttttcctattgcttcaggcacatgttgaaccacggtcaattcaagtttgagatctctgcagatatatacgtttttaatttgtcaactaaataaatacacagatacataaatacattgagctttctgaggagacctggagtctgcatattctgtggagttgatttgaatggagacccaagagtgtacctctgagtcattttgggtaagagtaatgctctatagttttttatctttttttggactttgaggacttatacaatataatgaaaaacactgtttttaagtctttccgcagtaaagattcttacaaagcaaaagataaaaagtttcccttctttctcatctacttgccatgttctcctcctgttgacaatatcctcccacttccctttcgatcttgttatgtatttggttgaatcagattccattgctgatatttgactacttagatgtattgtaacaggaatatattatgcaattatgcacccgcaccattggagccacatgatgaatgtatgcaaattattatgttagcatagagtgcaatactacacagtgtcttctgactcaatatccttccacccaagaaacacatcttggagattgttgcatgtcaacatgtggagatctattttgttctttgcaaggctgcataatgtcctatgttatagatgtgttctcttttttttgtatatttgctcccttattgatgatgggcattaaagttccctcccgtgctgatggacattaaagtggcctcccactaccaagttttcacagttactcacaatggcactctcgggtcatgcatctcagtgtgtgcatgggtgatttctttttataggatatattcctagaagtagaatacttgagctttaaaaaaaatcacttgtgccttttgcatcgtgagtgcttagtgaatttataattatttgatcaataatgaatgtgcaatgaattttatgagcaaagaactgtcacctcatatttggcaaaattttctctcacctcagacttgggctattttaagaaaaaagaaacctgaaacctcttgagtttttaactttcagttgtacttaagagatcagagttggtgttcagaggcagatcagtctttacgtggaggtgctaaggttgcaaattacaaaataattaggaaagtgattgtgtgtgcacatgagtgtacttgtgtacacattttggagattttatattcaaactgcaatgaaaaaaatatgaatacctgggtagctgccattttgctatggaggtccaaggtcacatatttaatagttctaaatttatacccctgggaaggaagtatatgctcactgtaccctttaataaaggcacagaaatgtaccgtgcagtctgcatgaaagcatgagtgagtgctattcattttaagaagcactcaagcactgtgaaaattagcagtggaacatggttccaaatgaaagtgacaccatgagcctaatgagaaattgaataccatctatttatctcctctagcccaagatctttctcttctgtcatttgaatgtttctgaaacgccttttcttcctgggctgagaagtgcctcatgccttcttcccctgcctctctggaaatgagagtccttgtgctgttttcctttctacgctcatgaagagtcctgctaggtgcatggaaactttgctttctgtttacatgtgcttctctgtcttgctaactcgttgtcctaagttttaggtgtgatagctgtagtggttttcatgaagccaaatcgtaaaggtctgagaaatacacactgtgtgttgcttggcttgtcttagagcaaaccaaaatttggaaaattgtctgggaagggtaagatcacttagctgtgaagcctctgcttttaggaactggagaagtgatttgagggtgaaaatagggtaagcgtatttactctttagctccttaaggaatgcttcttcaccttcttcaactcactgagtttgtgtttgaaaaatattccaaagcctttgcttaaaaataatgtattatataatatccttcgattaagtttccaacgtgtagattcttgttagcacttagtggtgcaacttttataaagaaacctggtatttttttaattaactgatgaaaatggatgtaagtaaggggtggacattcccatgtcaatgaatcttgatggtggcctccggtcactcatggaaaaatgtatttttgattacttgtgtgccagcaacgttgctaggctttggatgcatggaagcgaataagaaatatgaaagtcctacctacatagagcttatattctaatggaaaacagaaactaattcttttgccttagttacctattgctatgtaattaccacctcatagttgctgtggactgagagtccgaaagcatgtttgctgagtagttttggcaggtgttggcaggagctaaaatagtgtcaaggctctctttgagggggaccttcactgagctctctcacctggctgttagcaggctggaagtttgctgcccacagatttacctctggaaaggtgtcttgggacaaagtacatagctcctccagaataagcaattcaagagagaatgaaagaggggacacccaagacagagaatccagtcgcttttattgctgatttaggaggtgacattccatttctcatgctgcattcttttcatccctataattaattaatctagcctgccccgaaggggagggagttacacatgaacagggatcactggggaccatgttacaggctttataccacatttattaaatgcctacgctggggagcactgagaaaagcataaaatagcagtgatgcgtataataggcaatgacacttattgggggcttcatattgtatcagctgtgtaccaagggtaaggataatgaaagctcacatatatggagtaaccattgtgccaggcactgtactaagtggccatgtgccctttctcatttggttttcataacagccctttctcagtgggtaccgatcagtacccattttacagataaggaaactgaggcacagacaacaatggcttctgaaattctcttctccgtgtcatgcactgcatttttctcccgttcaccagttgcatcttaggtctcagttcattttcaccaccttcctgaatatatagagagaaagcccatgcagtaaaccaatcaaatcctggctatccgagctgctctatctgcctctgaaagcctaggagtaaaggaaaattgtcctcatgagcagttcatgaggtgtcattcaaagcacttttgaggcaaagtattatgtttcacagccatggttcccagtagggacagcaatattgcagtgaaatgcaccaacatctctgcccatcccaaactctcctctcaaaccagtttattgaaatgaggcctcacttcacaagtaaataagtagtcaagctctggatttgtctctgctccagcttactgtatatttccactaaatgagtccattaaagcttaaactaaaccttttggaaaagaaaaacaaagcccacagcagctgtccagggctgcgggagttagaaaatgcaattcatgtgacttggtggaatgccagtgaagctaccattagattattctgtttactgttaaggtacgtggagacagacaggctctggagatgtccgacctgcatttggatgacaggtattgaccacctccttgatgccaggcatggtgctatgcagaggcatataacagcacacacaggacacagaccatcccctcaagggttttgcagtctcgtgggagtcatcaacacaagatttaaataatgtgtcatgtgtgctagggagaggaagtttggggttctttgggaggatataaccttgagaagaatcaggtagggaaagtccatagagaagggtttgtttcctctgagatacgtaggccaagaaagagttagggaagtgaagacaagaggggacagttttgtcaaacatcagctataaatactcaaaagcagctaaaataatgatatatctgcaaaactggaagcagttcagtagggttgaagaaaagatagtaaagtgagggctggaatgggagggcagagaggtggcaggttggaagactagctaagcattttgggctttgtaacaagggcattgacacatgttaaactcgggaaaaactgatcgtttcattgtacgaacagcctagcttataaagttatttaattagaaaattttcagaatacttttgattcggtggtaatgtgtcaacaaccctaaaatgttatgtgtttttctgtaaagtatgtggatgtgaagggaagcaacatggggcatgattattaagagtacagcttctggaatcagagatcatgtaagttggaattctagcttatccaattacttaatgtgtgagtttaggaaaatatctattaacttaccaccaattacttaatgtgtgagtttaggaaaatctattaacttaccacaatctatagtacctcatctgaaaaatgggaataattaattaatactgagctcatagagcttttggaagaatcaggttaggtttttacgctgcatagcacattaccacctgcagaagcttaacacaacactcttttgttatctaacagtttctgtgtatcagaaatttgagcatggcttagctgggttctctgcttaaaatctaatagactgcagtcagggtatcagccaggactgggttctcattagagactcatctcgaacaggatctgctttcaagctccctcaggttgctggcaggattcattttgttgtagctgcaggattcgtggctgcttgcttctgcacatccagaaatgggtggagagagagacagagacagagagggagagagatccagcaagagagttgctataatcttatgcaatcacttaggttgatttcctctctttgcaattgtgaattgtgctgcattaagcatgcacatgcaggtgtgtttttttatacagtgacttgtattcctttgggtagataaccagtagtgggattaactggatcaaatggtagatctatttttagctctttgagaaatctgcatactgttgcatactgtttgccatagaggttgtgctaatttacattcccaccagcagcatataagagtccccatttcaccacatccatgctaacatctattgttgtttcactttttaacagtggtcattctggctgggtaaggtggtagctcattatggttttaatttgcatttccctgatgattagtgataagcatttttttcatgtttcttggccatttgttggctattctcatcttctgagaaatgcctgttcaagtcagagactcagaaggagggaggcaaggaggagggtaaaggatggaaaattacctatcgggtacaaggtatgcaattcagttgacaggtacactcaaagccaagccttccccactatacaattcatccatgtaagcaaaagccacctgtgcccccaaagctactgaaattaaaataaaccttatataatcacatacatgtaatcacacttatcttatcacctctgtcatattccattggttagaaacaagttgtgggtcctgctcacattcaaggagggattagtaaaggcgtgaatgttaggatgtggggatcatggtgagaagaatcctcaaggatgcacaccacaagaatttggtaaaattgtacacataaggacagaatagaagcatttagccttgtgaagaattaccagggcaccgaaagagagaatggaagcatataccaaatagagcacatagagaacttgctcagatctcttaactgttgttgttctggttatgatatgatttttaggaacatgtggcagagtgtttctgtgagtttggtagcaaatacatattggatgtacttgcttagtcagttctgtgtgccagaggacactcatggggagagatcaaggttactttttgcaggtggggcattttgtaactgaataaaacccagtcagtaaaagtaagcaacatgcggaatctaggcaagtgttgcaatgtatgtgtgctcttgatctgaggaagaccatgcatttgactcagactagaaacctacaccacagaaatcccacccacaagcaatgctctattactgtaggtacaaggcagtaatttttttgtgtccattcacatatgcatgtgtgtttgtgtgtacataattgaccaactatcctcaggtttccctatggtgaatgatttattgagtcatcagacttgtggaacacctactctgtggtggccatgatgccagcctctagagataaaaagtacaataaacgagctatcttaaggaaactcaaattactttggcagacagaactagtaaactgaccactgacaattcaaaaatccatggggggagttccatttcgagttagatgggatatatttagggcaattcccatcctgtttcacttagatatgtttcactacatatcaaagtaaacttcagaggaaaaacaacaacaaaaaaccacccagacatacaggaggacattatataaggataagagggccaagtcaccaaaaagacaaaacaatcttaaacaatcatgattatttatgcacaaactatgggacttttaaaataaagccaaaactgatagaactgaaaagagaaatggagagtctacaaacataagtgaagtctgtctcactatttgataaaattaatattgagaaaattaacgaggctgtagaagtactgaacaacaccatcagccaacaaaacatagttaaaatgtgtaatcaacaccatccaacagcagcaggatgtccgttctgttcaagtccacatgagatatttaccaagataaaccatattctgtattataaaaaacttaacaaatttaaaataattgaaatcatatagttgctttcctctgacaaaattgagttaagctggaaatcagtaacataaaataaactggaaaaaatctaaaagcacttggaaattaaaccgcaaagtctaaatcacccatagttcaaagaggaagtctcaaggggaattatagaacttaaatgaaaatacattttacaaaatatatggtgggaagcgaaagcagtgcttagagggaaatacataatgctaagtgcttctattagagaataagaacgttctcaaatcaacaatgtaagtgcatatcataagagactattaaaaaaagcaaatcaaaaactaatacatgcaaagagaaagaagggaatagtaaatgtaagattaaaaaaatgaatttgaaaatcaaaaagcaatcaaacctaaatctggctctttcaaagcatagaagtgatgaatctattctagcaagactgacaaaaagcagagatgacaaaaattacaaacatcacataaattaaaaagattataaggaaataatcaaataatctatgcacatgtagtcaacaacttacatgaaatagactaattccttgacaaccattaccaaaacttattcaaaacaaacaggataagctaaatggttcaatagacttatttaaaatatcctgccaaaataaaaattttcagacacaaatggtttcattggctattccaccaaacatttaatgttgggaaaaaaaaaaaaaaactatacacagtctcttacagaaaatagaagtggaagatatacttctcaactcaatttatgagtctaacattaatctgatacgaaaaccaggctatatgtaatattttatatatgtatatatacacacacacacacacacacacacacacatacgtaaacatatatcatggaatacatataatacagaaaaataataacatagcatgaccacatagtattagtcccaggagtccaaggctggtttcatattgaaaaaaatcaatgttatgtaccatattaacacaataaagaagaaaactaacacatgaccctgtaaaatagtcctgaacagtattggaaaacaaaagctaatctacattgatgataaaaactctcaactaactagaaatagaaggcaccttctgcaacctggtagaggatgtcaacaaacaaccccacagctaatatcatacttattggtgaaaaagtgactgctatctccattagagcaggaacaagggaggagctccactctcaccaaacttatgccacatagtactggaaatcttactcactacaataaggaagaaaaagaattatagagcatatcggttggaaattaatatataagggcatctttaatcacagataatagaattgtctatttataaaatcccaaggaactctaaaacctcttaggtgaaaacataaatatcaatcatatatctatatactaggaaagaacatttggaagtcaaaacttaaaaacaaaccatttacaatagctccaaaaaatgcaatacttagctataaatataacaaacatataagagatctttatgctgaaaactataaagtatttgtgaaattaaaaaagcaaatctaaatatatacatagattcaaagactcattgtagtaaaagtattaattctgtacaaattggtgtataagtttaacacaatacaaatcaaaattctagcaggtatttttgtagctataaacgtgaagattctaaaaattataaggaaaaacaaaaactagaatatccaaaataaagaagaataaaattaggtgaatatatctaatttattttatataagcctatagaagtaaagatagtgcaaaccagtaaaggagaagacacattaatcaactggacaaaatagagactccagaaatagacccacaaaatatacttaattaaatcttagaaaaggtacaaaatcaaaggagaaatgattttgttttcaacaactggtgttggaataattgcaaacacatttgccaaatcatatgctttacaaaaaaattaactcaaaatggatcatagatctaaatataaaacgtagaactgtaaagttttagaagaacacatgggtaaaatattcacgtccaaaggagttaaaataagaatttttggccatgacaccaaatgcacaatctcacctccccaaaaaggtttaatttgacttaacaaaattgttaataaattatatgtgaaggtctctattaaaagaaagaaaatacaagaatctgtaaagaaatatttgtaaaccactcttgacaaatgttcagtatctagaatatattttgaactctcaaaacataaaagtaagaaagcaaacaaactatcttaataatgggaaaaagacttgaatagtcacttcacttagagtatattcatactcctttcttattgggtcctgagtggggggaaaagaagagaagaggatattcatcaggcaaaaacctaaaaaagaaacaaaaaaccgtgaaaaggtatttaacatcattagctattcagcaagtgcaaatgaaaactaggatggaataccattaaacacctagtagaggcataagataaaaaaaattgacaagacttagtgctgtggaggattcagagaaactggatttctcctgtactgctggtaggaacatagaacaatgcagacattcttaaaacattttgacagtccgttacaaagttaagtatatgcttatcatagagcctagcaatcctactcctgggttccttacccaaagatattgtatatttataaaaaacatgtacatgtctgtgtatagcaactctaccatagccccctagaaacaagccatatgtcttcaaatagatgaatttgaagcattacatgtacacgtggaatactactgaacaataaaaaggagcaactattgatatatgtgacaacttggatctatttcaaaagcattatgctaagagaaggaagccagtctcaaacgatgacatagtgtataaatccattcctatgacatctgcaagaaagaaagctgtaggtttggggagaaaagatcaggggctgccagggattaggggttggggggagggtagttgcaaatgaatagcacaagagagtttttggggtgatggaactcttctgcttcctaattgcacagccgttataagaatctgtaaattatgttaacatttatgaaattgtacatccaaactttcaaatttatggtatattaattccaaataaatgcaagcccatagattatatgaggataaagtctctgcatatttttgttgttatatctccagcccatagcatcattcctggcaaacattacacatttaaaaatatttgtggatggaataaatgaaaaagtgtagaattaccattgttattattatttatttattattttttgagacagcggcttcctctcttgcccaggctggagtacagtggtgccaatacagctcactgtaaccttgacctcctgggctcaggtgatcctcctgccttagcttcctgagtagctgagactacaggtgcacctcaacataattggctaattcttttaattttagtagagatggggttttgacatattgtccaggttggtctcaaattcctggcctcaagcaatcctcctgcctcaacttctcagagtgctgggactggaggagtgagccaccccacctggcaaaaattatcttttaaaagccatatgttaggagctagtttaggggaaatatggtgactacttggacatatatatttatattgtatgatgatactttacagctatagattactaataatttataaagtacattgttttatatttagaatttgcaatataagaagaagggttttgcacgagggtggggctgtggtcatttgatccagtttctgttttaagaacatgccacagtctgcagtggagaagagaaaggagagagggaaagtggaatctctaagttgtattaatgctacatcagtgactattcttctacataggtctttgtgcatatgatgtctatttaattctaaaaatggaattactaggtcaaaggttatgtatatttagaaatattacacatatattacatgaccctcccaaatgcccagtgttttatacttttaccaagtctcaggagagttttcaacgaacttgtacataaaataaaagctggtggcatggtggctcacatctgtaatgacagcacttcgggaggccaaggcaggaggactgcttgatctcaggagttgaagactagcctgggcaaaaatattttttaaaaaattgccaggtgtagtggtgtgtgcctttggttctagctactcaggagactgaggtgggaggatcccttgagttcaggaggttgaggctgcagtaagccaagatcacagcactgcacgctagcccaggtgacagaatgaaactctgtcataaataaatagataaagctgatacagtatctgtaatttgaaatatgtactgtacacttctgaaccaaccatcctccctcccttcctcgctccccctcccctcccctcccctcccctccttccttccctctctccctccctccctccctcccttccttccttccttccttcctgtaataagttgtgagttttctcataatgtcttcaccaatagggcaacacatgatagccctcatttcacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgacaaataaatatttcaccagccagtgacagcgttatgagctaattaaaatctgagccctggaagaagtggtgccattagctcaattcacaggactggaaagtatgtgtctgctcacggactgagaggtagacatttacatatgggaaggagggggccggcttattaagagcaacattgaggtttggatgaagagagcactctgtcaaagctgagatatttaaagaaaagccaaaatgacaatatgagaggtttcttttgcccttgggaagaaagaggtaacactgcatggtggtgttaagtgtaagggcttgggggacgggccacactgtcttgagttcagatcccagatctgccatttagcagagatagaactttggggttgtcgttcagcctttctaacctgcagcatcctcatttgtgcagtgggcatagaaatccacatagtggcaagggtataaaatcagatactacttttagatcctcagcagagtgccaggcaaatcaatagatggttgataccttgtcactagcgtcaactcttgtatccacaagaagtcatgtttaaacgtccagttttctgttaaaaatttcaaacctgtcggatgctaagcagttttctagtttgaagtttgttccttcagaaaatatggttaacacacattttttgataacttatgatgtgccaagtcatggatggttctaagcattttacggtcaacatctcatttcatcatcgcaataatatagaagatggatatcgttaactctacagaggaagctgaggaacagcagcaatgagttatttgctctaaaatttaacactttttttttttagacagatgcctaaactccctttgtttcacacaactatgcaaattgtgaggccaaggatatgactgcaaacgattaaggtttaatttacatgaatagccaggcgaagtgcctcacacctgtaatcccagcactttgggaggctgcggtgggtggattacctgaggtcaggagttcaagaccatcctggccaacatggcaaaactccatctctactaaaaatacaaaaattacctgtgcgtggtggcacacacccgtaatcccagctgctcgggaggctgaggcaggagaatcacttgaacctgggaggcggaggttgcagtgagctgagatcgcaccattgcactgcagcatgggcgacagagccggactccatctccccccaccaaaagaataaaaaataaaaaagtttacatgaatgagctttcttccccatgaaaataactgtgtcacttctcccttggtctaacccacacaaaatccccaccctgtctggcacagatacacttaacatgcaatattaagtacaatttccattttatttttctccagagtatcgtgtgtcttcagtcttgaaggactcagctccttacatgggctttggtgggggtcatggggcagcacccgcaggtctaaatcgaggtgggggtttttggtccctgtggggttcacaagatcaattcctgactactttactgtgaactgtgcagctcacacagtaacgtggcttcacatacagcttgggaagcacaaaggcatcgaagacgcttgcttcagaaacatccctgactgctgtggcctctactatgttttgaatacaaatttcttaatggccttgtctttgggcacgcgctgggcacagttcgtgcagcaaataggctgcatgtggctgcagccctttttggcatgactgttgttcttccttttcttagtcatcttggaggcaaggaccggagatcctaagttgttcttttaaatatatatgtatatatatataatattcgtctgggtacattggctcacgcctgtaatcccagcatttcgagaggctgaggcgggcagatcacctgaggttgggagtttgagatcagccaaagattttcttttagcctggccaatacggtgaaacctcatctctactaaacatacaaaaaaatgagctggatgtggtggcaggcacctgtaatcccagctacttgggaggctgaggcaggagaatagcttaaacccgggaggcagaggttgcagtgagccaagatcgcgccactacactgcagcctgggcgtgacagagcgagaatccgtctcaaaaaaaaaaaaaaaaaaattattgcagacctaagagaaaatctggttggtccttcctagaccccttttgtttaaacagctatgactgaggggagcacttcatgtggtcataaatggtggctggtgttctacccctgactgtgattataatttcagagaaagaaaagtctctgtgaactagccacaaatgcctccgaaagcataaaatcgttattcagcattctccatactttcctgtatccatggtgttgtcagcaatatgtaatattatccatagtacttatgatactgtgtttgcttggtctcaagagagaaggttaaaagtaacaatctcaggtctggttataagcattttgtaaataataacttatttgatacttattatcaccctatgcacttagccactattatccccatcttatatatactgttatgtcaaggtagggagaaataaatatgttaagaaataaatagagcagtttttgatgacagggatttacttacaggtcttttggtatatggtgtgtactgtatgtgtatgcacgagcgtgcatgtgtgtggggaatgtgtacattctgtatcatggtgtgaataagttgagagtgagagtcgggagtaagggagatgacaattgtgtggtgatgatttcaagttaagagtataaatgtggaatgaatgagtttctttcagaggactttgggttgtatatgcttcaaaacgagcttttatcttctgcattcttcctcatagccccgtggaggcaggctgaagccttggcacatcttggtaggatgacctgactgagagcaaaggtcgtttgcaagcatataaggactttattaagcagcatattaatcaggcactgttggttgcaagcaacagagtcacaatgcacctggtcttttgtttagaagagggagttcattggcttacacaactgcaaaggtccgaaagaggctgggttcagatgcacaaatacacggtttgaaatctggttctttgctgtttcttggctcagcttttcagtcttgacatcgtcctctggcaaattcttccttaatgggggctcaagtgatgcagcagctccaggcttactttctatgaaatggacagccctggtgaaaagcaaatgtctccttcctaaccattctgacaagaacaataaaatcctcaaagattttctttcaaagaataatagcatgtattaagtgccagacactaagtcctttttgtatatgaactctgttatttccttgaatcctcacaataattctgcaagataggtactatacttaaccccattttaatatggtaaaacttagttacagaacagttctgtcacttagctattgctgtgtaatgagctagtccaaagcctagtggcttgaaagagtgaccatgagtctgataaattggcaaaccaagagagcctgaatcctccagggtgacatcagcggggatagttcggttctgtacgtgtgtgtctctgatatccccagcaagctagcctggttcacttagtgaggtagagatacagcagtgagctggcacaattgtacatgcagaaggggcaaaggtactcaaagcctggagaggctcatgctaggaactgacacattctcatttctaccctattgttaccagaatatgttacaagtccagtttggattcagagggtggggaactaaactctaccacttgatgggaggatgttcatggtcatatcacaaagggctagaactggggaagaatcggaggctattttggtaatctgtctgacataatggtaacttttttttctttttactttttttttttttttttttttaagacggagtctcactttgtcgccaggctggagtgcagtggtgcaatctcggctcactgcaacctccgcctcctgggttcaagccattctcctgcctcaacctcccaagtagctgggactacaggtgcatgacaccacgcccagttaatttttgtatttttagtagagatgaggtttcaccatgttggccaggatggtcttgacaccttaacctcgtgatccgcccacctcagcctcccaaagtgctgggattacaggtgtgagccacggcacgcagtcataaaggtaattaaacttgcccaaagttagatttttagcaggattcaaaccaggaaagtctggctccagagtacaagttcttcctcattgcaatgttctttatatagtttttattgattcggcttggatagtaaccccacaattgaaccaatcattttggccaggaaaacaaagtgtttcatcggtttggttagatttgggtcctgtcttcatttctaagatgaggtacaggagtcagccctacctaaaccatgggtactggaagtggcataggaacagtagctcaaaggaaagttattttcagaagaagtaatggatagagatcaggtgacaaaataatatcccccactgatagggatatggtaggggcaattgggtaaatttcaaggataagaccttgccatgatactcttggattacaatggagagacacatttgccctatctcctggggaaaaaaattgaggaattacagttggctttaagtgtatgcatctgattgttgactagatcatgaggaggataatgtggacattaggaagaggggccttgcagaaaggggcagaaatagcaaatttcaagtgcctgggagcccccaaatcgggttgtgtgtgctatttttaaagtaccaggagacacgacaactcctagctgcaaagagacatttatcacactgaaaaaaaaaatgagtgaatggttagacagatagatggatgatggatgggtgggtgggtgggtgcatggatagatggtggatgaaaaaataagcaatgaatgaccctctagatgataagtggaaccctgctttgttttccatttcctgcttcaaatctcatttgccagcaataccaaataggatatatactcctctacttccatctatacctggcctctaatcttcttcatttttgaagattttttttttttttttttgagacagagcctagctctgtcgcccaggctggggtgcaatggcgagatcttggcccactgcaacctctgcctcctgggttcaagcaattctcctgcctcagccttccaagtagttggaattaacaggcacgtgccaccatgcccagctaatttttgtatttttggtagaggtggagtttcgccatatttggccaggctggtcttgaactcctgacctcaggtgatctacccacatcagcttcccaaagtgctgagattgtaggcatgaagccaccacgccaggcctgaagactgattatttttaagccagctgaatgggttaagtgtttgtccattgtgctctggaaattctctgagcgtattcacattattacacttaacacttttgtgaaccacatccttttaggcaaaagtgatcatctctgtctcactcattgcagtactctaatgcctaacacagagcctgacccagagagagtgcactgcaagtatattctgaatgatggagtgaaacagtgagtcagtgtgcaaataatgtgtgttgataagcatatgtagggtctgcagtggtgatgtaggttttatagccaatgacatctccagtgcctttttacttgataaatataagactataattttcttaaaagcataaataataggaagtgttctcgaagcccattcctggccaaattctttgcctttaatatcgtgcttaaattttgtcaacgcatttcttttaaaaaatggaggaaaactgagtggggaacaagaacactttctcatctcattcataatctatcaggcaatcctggggtgccatcaagaagagatgatgaggcgacagtgacacagcaatgactgccttcagttttatcatcagtcctggatagagaaggtgcaccacctataagtgaaggtgatcagtttttccatttccaaagagatgggtatcttaaaagttagaaatttgtgactttgaattgcctttttaatcataagaatcatagcttctggccgggcatggtggatcatgcctgtaatcccagcattttgggaagccaaggcgggcagatcacatgaggccaggagttcgaaacaagcctggtcaacatggtgaaaccacatctctactaaaaatacaaaaagttagccaggtgtggtatcgcacacctgtagtctcagctactctggaggctgaggcaggagaattgcttcgacctgggaagcggaggttgcagtgagccaagaccacaccattgcactgcagcgtgggcattgcagcgagactgtctttttttttttttttttttttttaaaaaaaaaaaaaaagaatcataggttctgcttagtcagtgcctacttatgttttaagttatagttggccactttacatctcttgcttctgctccggtaggtttcataatctccattttatagttgagggaatgagtacctgaaaggatggaataaactcaccataatcaacctagctggcaagtgattggaactgaggtttgaaccatgttcatttgactctgaacactgcagtctttcctgaataccatccctcaagcagagagttgggcccagatgagataggcagagcttccttagcataaagtcaatattgtctttttgccagacagtaagccaagcataaccgcatacatctgaccagaggctcttgtacaaattggccactcaggttctctgaaggagcttgatttggggcctgtgaatagtcctgtgaatattgggatacatgagattaatttttccctacatctaaacatccaaatggcttaacttccagaggggcacatcttagcttctagggggtgagaggcttcccagtatcttaaagaagtggttcttaatctcactggcaagttagaatcacctggagaactttaaaaaacattgatgactagagtcctttttttctttctttttttttttttttttgagtgtcattctgttacccagactagagcgaagtggcacaatatcaggtcactgcaacctctgccgcccgggctgaagcaattctcctgactcaggctggaattacaggcaccttccaccatgcccagctaatttttgtattgttaatggagatggggttttcccatgtcagccaggctggcctcaaactcctgacttcgactgatctgcctgtctcggcctcccaaagtgctgggattacagtcatgagataccctgtccggccagagtccaagttcatcattgcaatgttctttatctgtatatatttttaattgaactcctatgttcactgcagcattatttataatagctgagagatggaagcaacctaaaggtccattgatgggtgaaaggttgaagaaattgtgatacacagacacacacacacacacacacacacacacacacacacacacacacacacagtcactttatcttgaataacataagacaaatgtattcaggtataagtattaattcatggtgccttgcataatggtgagaggcacacatgtttatgaaggcagaagtaaactatttgtaaagctgaaaaaaaaaaaccacacacacacaatggaatagtattcagccctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaattaattgtttatttaataagtggtatttttctgagttctgcttatagtttctttagacgtagaataacacatcattaagaaaaataataattgatctgccatgaaaaaaaaagaatgactgacacagcttctttgctgtcagcccttttgtactccaaaacgtaatgcccattttgaaatatcatggctaatccaaaaaatatacagctaaacagaaaaacaacatcagttccaaatatgaatacatgatctgctacttaatatgtcagggtatttgtcaggttgataacattaggctctgcggcattcaattctaagccttgcaatatttgaagtgtgatactgtgcttcagtaaatttaatacgtgggcctcagtaatggagggaatcacgttagcacttggcagtttgttatgctgtataaaattgactgccctgcaaatacaatagcgatcataaaaacggtggtcagcagagaggggtgtaatgcatttttgaggtttcagtaaaggtccagatgaaatttattgagatttttgccatttggatggtgatcaatagagctgtgctaataatttgttgtgaggatgttctctggggatatgacattttgctgtgaaactttggaaattcagaaagtagactaagtgatgatactgctccagtatatataaccgtcaaagactttaacatcgctctgggagaggatttatagtgatggtgattacttcttcaggcattgaggatgtgatgcatccaattattgatatgttttcatgcattttccagtttggactcacagtcatttgatcgtattgctgtttcagcccagagttttgtgataggtttgtttttaatttcattcacagtttccaaattgctagcctattttcttaattatatcattgatttcccctgcctcctctcccttcaccctgcccacatccagaaaatgatcgttgaagaaaagaattccgtcagctttcattcacatcaacagaggctacttagaaatcctgactgtgaaaactacttttgttgtgttgtagttgctgttgctgctgctgtagatggcttgtgtgctgtaccgaatttgcaaacaggcttctgagttaatgttaaaggagtacatagcatgcagataatgtttgtgatggttacagttttaatgcacatatgtcagtggacctgttaaatcactgtgaggcagcattctttggctttatggtggttgccgttgaatttatcttttttttttttcaattttgattagccgcgttccaagagagagagatgaattatccaatctttgcaaagtgggattccacactgacaatacagagatatcattctgagaaaaataaaataaaacaaaataaagaaggttttaaaacttcacatttggtaaaactgacttatcctgaggctgtttttatgtctgttctgtatgttagaaaaggaatttctgagttcgtgtttatttccctgttacattgttctgtttcctcagtgtatttcatgaacctgaccaattaagtttcagccctgtctaggaatttttttgttgttgctgttggattaaagcaactaagtaactctgcagtggacagaggcttagagagactccacattatttgtttgcaagaggaaatttgtcagcactttgcagaaagaacactgagactaggcacagcagaacaatttattttcaatgagcatgcacaaagtaagatttatgactttgcatcttcgatgacatttcttacattgttaccaagctacagcaaattaaagggatccgtgaatactaaggggtgtgtttttgtaatgaggaaaaagagacagagcaataagaagataattaaggtaacaacttgtgaaaaattaaagtgtttccatctttcatttttgaatctctgagcataaactttgtagttgttaatttaattgccgctgttcgcggcatccctgaagaatattgaggattaatcgtctggttcattccaacaagagataaggcctaagtgaattgaaattttaccaatttaaccctgtcttcctcctaatatgacatgattaacatttttcaattaaccacatgtaattattctgaaggcctcattccacttatttctagtctttttgactgcagattggccttttcaggtagtttggatctagaataattcaaagaaagctctgtttgttctattttgcatctggcacacaggttcatctgcattgtctttggagttgccatttcatcggaaaataaagatccataacagttgcattcatttttgcctaggtgctcttcctgtaaagcacagtgctgctcattgaagcctgaaggagtaatgtggtattgttggagcatatttgtaactgagcagagtgaaagactaaacaccttgcaggcaagaatgtcaaaggaagagattggctggaaatggttttccacagtaaatggaaagacctcaagattcgggagagtttggcatttccaaggaacagaataaaggctagttctttgtgttcgtccatatggtagccagtaatcacagtggatattgaaatgtaaattaattaaagtttaatgaaatcaacagttcagtttgtctcatattagccacatctcaagtgtccaatgacccccctgtgactagtagctgtcatattggagccaatacctagtagagatacagaacatctctatcatcttgggattttttttttttttttttttttgacagggtcttgttctgttatccaggctggagggcagtggtgcaatgatggtgcaatacagccttaaactcctgggctaaagtgattttctaacctcatccgctcgagtagctgggattacaggtgcacgccaccacacctagctaattaatttgtttgtttgtttgttgtgtagaggctgggtctcataatgttgcccaggctgatcttgaactcctggcctcaaacaatcctcctgccttggcctcccaaagtgttgggattacgggtgtgagtcacttcacctggccccatctagggaaaattatcggatagtgctaggccagagcacagtcatcaggtggatagtggttagtattaaccagggcattctaaattctgatatggcaacaaaaatctctgtaccagaggggttaatgctacatgggtttatttctctcatacacaaaatctactgcatgcctgggcaggaaggaggcatctagaagtttgcgctggggccctttcattcctcgtcatggcccatgggccaggactggatgcccatgccctgcctccctgcaacaggacttttatttcagtcttttgtttgccaactggacactaagttcctatttgtatcaccaaacactattattatttctattctataaaggagaaactgaggcccagagaagttagatagtctaaaataaatacctaaagaatgatgcagtgggtttctaggtacatctgagtccagctgcaaagtctaatctttactgagctagctggactcttctggtgcacactaggaagtcatcagaggctttccagctttagaaaacctattctgaccagcacaggtgatacggtttggctgtgtccccagccaaatgtcatcttgaactgtagctcctgtaattcccacatgttgtgggagggaactggtgggagataatcgaattgtgggggtagtttcccccatactgttctcgtggtagcgagtaagtctgatgagatctgatggttttataaggggaaaccccttcacttggttgtcattctctctcttgcccgctgccaatgtaaggagtacctttcaccttccgccatgattgtgaggcttccccagccacgtggaactgtgagtccattaaacctccttttctttatacattacccagtctcaggtatgtctttatcagcagcctgaaaacggactaatacaaaaggaaacttagaagggaacctcagattaggggcaagctccttggttagaagcctgatacgtgacaacagcaacttaactcaaaggaataatggtggtaaactcgaacacataacattatgcaacagtccctacctggtcctggagtagaaactccaaaaggggaaggttgtagttcatctgcaaatgtatgtgcacaggctcactacatgttttggctgatttttattgagcatctgtgatttgccagatattgttttaactttttagcttgatgtacattagctaattaaatactcaatatttcagtgagttagcctctattttcatggttttacagatgagaaaatgcacgtagagagaggttaggtaacttgcccgaggtgacacagcagaggagctggaattttagtcaccatcttaagaatgaagcaatgtttggagagaatggtgactcagagattcgtatcacagccaaatcatacagaaagcgctgttgactcaaatagggtaaacagataatgcaaatccaaagctttgggtgtgaggatcagatggggcaatgaggatggcgaaaggaatacctgaagtcatgagagatggtaagattgctgagagggtgcagatataaagggagaaaaataagaggccacacatgagatcttcagcaacatgactcattaaataagaccaagggtttcagtgttaaacggacttctgtaaatcttggctttggcactatgtcacatgggcaagtcatgtaactttctgggacaagatttccttattggcaacgtggaggcaaggatgctcaaagcaccagacccaaccaggacaaagaagagaatgagcatgcacatctctgcccacaaactcagtcttggaataagaagcacagttttgtgttattgtgaaacaacgttaattttatcctcatccccacttttccttcatggccaggaaatgtaaccccccattatgcaaaagataataattctcacctggggcctacaaaggtgaaggggatggggaggacctgcctaatcatctaccttcatcatctcccagatatataggctgcatttctgcaggccgtatgcttgagacttgaatatttcactaaaacaaggaacacacatccatttccctttggagagctctgctgctggataaactcagactttttttataagatggagtctggctctgctgcctagcctggagtgcaatggtgtgatttaggctcagtgcaagctccgcctcccgggttcaagtaattcttgtgcctcagcctcccaagtagctaagattacagcctcctaccacctagttaatttttatatttttagtagagacaggtttttaccattttgagcaggctggtctcaaactcctggccccaagtgatctgccttccttgccctcccaaagtgctgggattacaggcatgagccaccatgcatggtcaacttacagattttgatattcttaccagtgtctggacatctcttttataatgcagatgaaatcaatctctctctgtgtgtgtgtgtgtgtgtgtatgtgtgtgtgtttgtgtgtgtgtgtgtctgctcctcctctcttctctttctttttctattttcattatagctactctgtcactccccatgcagaacatccaacataatcacttcaacaaccagcttttggaaaagcaaaagcttcttacagacagaattgtctttctgccatgcttggcttcatccctccactaactctattccttttccttcttgagttcagagacaaagagggtcctatatacctacctgtttgagtgatggaagagaggaggaaaatcctaactaaatagccccagatagtttgcaaccaggtttttaaaatgcttaacatggttcctggcatattatctgtgctggatcaagggtaagggtaacttctactactactacttttatcagcaatggtgaggaaaggatcagagacctgagtccaccctcgacagtttcagtttttggtaaagaggcaagggagaggagaatgtttcaagaatgttgggttggtgaataaaaccaaaggccatgaagaggttgaagactgagaaatacattgattggattcttttttttttaagttcatcggtgagctttcagggggcagttttagttgctgtggacagaagacaagcattcatgtcttaaggaatgaggaattgaggaggaagctaagacccttaggatggggtgagcttgtaaaatgttggctgtggaggaggaagaaggtaaagacataagcctggaaggaagaactgacatgagttttagttgctgacttgatatccaagtcaagactgcagtggatcccaggacacctggaaaaagatagctgtctgggcattaggggattaggaatattagccaaagaatggtaggctctgtctaggtatttatggactgttctctctttctctctgcatgaaactaattcattctcattctcttattctctccttctctccctctctctctctctctctctctctctctctctctctccctccttctccctcccaatttgtccattttctgaatggacaaataaattttgtccatttttttttaaatggcttttttttttttttttttttttagttttttaaaggtcaccttctcttggttatttttctgaccacacaaagtttcttttccccactctgagtctgtatgataggattttcttcattttctgtgccacttcgctcagtttgcacttatgttttcatggctatattgtctaacttcccaaatatgtagttttgtaaggagagaaatgatttcttcaatttattgttggatacccaggacctagcatatagtatgagtttaataaatacatcttttaagtgcataaatgaatgcattgatgaatttgggggcatctttctatttttttaaaggaatgaataaaagaatgtggcatatttctaggcagagctcatcaatatctgaaccaacaattcctgtgtgaaacgctgaaagcagaacctctcagagtgatatcctgtgcaataattattggaactgggagtgagagacggagacttgaatgaggaaatatttatggggaaggtagcgttaaactttccaggatgtttccttggtatgctcataatggatttcaaagatccacacctcttggcggactccaggagcaggatttcatgaagctcttttgtgaaatgcttccattaggcgttggcatctttcccaaagggattcaagcatggtttctaagtgtctcagagcctaacgtggaattgggagagagaaggagggagtgaagaggaaccctcgttggaagtaataatgaagcctcctccagctttgcagagctctgccaggaagccaccctcagcaaaccagggaacctcctgacgatgagctggggtggtttctgaaccatgagtcatcttgtgcaaagtggctctggctttatcaggatgatgtgtctagacttgcagtcagctggggagcaagtaggaggatcctggggaggaggccgggaaataatgggtgagtgttagtgctggatccagatcgcttcctgcccttcaaggagttaagttcagggcatctattcacacccaatatttattcattattcacccacggaataccagacacagtgcttggttctgggaatctaatgctgaccaagacagataggaccccttctctgatggaccttaaaatacagcttgggcggcagctagaagaccttatcgcatgattgttaatccaagttctcaggtgtgctctaaggggaaaatgcgcagcagtcaatgagagcataaagcacggaaatggagttttgctagagtgcatcaaggatcattgttattttatttttatttttattttggaaggtggggccatttatggctccctgtaccagatgaaagattgcatgttcattaacatattaatgccatttgtagtttggatgagttaaactcatctaactttagtgtttacaagggatgagctactatagtcttttggatcccttcttctcctttacctcatcatcctatccaccagtaagttctaatccatctttcctactctgtccctgctgtcaccagcctggtcacggtccatcatattgacgaccgcaccagccttctgactggacaccatgctactgctcttgtttcttctcacctattctctgcacagcagccatagtgaccttggaaattcataaatctgtcatgtcagtccccttcccccttaagatgtttcagcgggatcctatttcttattttccttctccttcttctccatcttctccttcttcttcctccttcttcttccttcttccttctttcttctttttatctgagacagggtctcactctgttgcccaggctggagtgcagtggtgtgatcatagctcagtgcagcatcaacctcccaggctaaagggagcctcacacctcagcctcccaagtagctgggactgcgagcacacaccaccacacctgaccaatttctgtatgttttgtaaagatggggtttcatcatgttgtccaggctggccttgatctgctgagctcaagcaatcttcccacctcagccttccaaagtggcgggattatggacatgagccaccacacctagccaagtcccatttcacttaggaaaaaaatcagactggttaccatgcccgtgaaatgaggtccatgtcctgagcttcttgttgatgtcatttcgtgtcactcttccatcagcccctgtaccgcaggcgactctggcttcctgagagtccctggaacaatttaagattgtgtcctacccctgagtgtttgtatgggctcttccctatactgttctccgcatggccggctctttcttagccattgggctgtgcctcaatattattttctcactgggattttcccttatctactcatcttctggactgtcaatcagagcattttgattgataacagtttaatcagtaattatcttgtttgtatatacatgtctttaatatgtgtctccctctctaaggtcactgcattccagtgagaaccacctctactgttttgtatatgacattcccaatgccttacaccgttctgaacacagtgttgcttaaaccagtattgaatgaatgaaagatagaaagaaaatggtcagccctgagtaattttctcttatttttcttctcttttccttaatatcatctgcagacacatctgcagagtattttttttttttctgtgagaatccatttctacctatgatatagctggtttctgacccttgagatatgactccaaaattgggactgggtggttgagagtgctttaggagaggtaaaatttgtcattaatactattgtttatgtgtgcagtgtccttcatattttttcctttcatatagcatttgacatttgcaaaatgttttccatttatttttatgttggggaaagcaaaaagccgtacgtgttttttggtgtaagtgagcataaaagcaaggcatctgattcagggtgatattttttgtcattttctttgtgttttgatcagggaaaattagagagagagagaggaagagagaggagaaatgacaatgcgtccaactgttttccagccctcctccaccgcattcccgacccagctctcagggagaggactgagccactgtagaaaagtgggaacattaaacgacccaagaaaatgtgaaatggtgtggggtgtgagatttctttattagtcaatttaaaataaaatgtgcctcagtaatttagaatctgtctggagtcaagcagaaaattagccatattcccatatcctacccccgcccctggaggcagcagaagcaccaataaaaataaaaataacaataccttgtatttatggggtagctttctcccagacctccttctcactcaccctttttatcttttctgtgtccttgaaggggagtgagtgagtctctgaaacctgggagttcagctctctgcagatacgatcctcagcattaaaacttctccaaagtccttcatttgatcatacattcatccatgggtttattggttcatttatactatttagcagtgcttactgagtatctacactgtgcttactgtgtatactgcttatacacagtatatcttacaggtagtacaagatcctagcaggtactataagatcctagaaggtaagagctactactatatagtccctaggagctattactgtaatgtctattcacagacaatggaataatcttgttagttttttttctgaaaacaatcataactctctttaaaccatggtgttgtctttggaacattcatagtttggttcctgtgtagttttcaaggtccgtaaaggctgagtttcgggttgatgtgtctgtaggctttttcccttgggggaaaacgtcttcatagaatttgctcctctaggtaatagatcatgaatatctctctagtttgcaaaaatgattgtttaagaaaggacatggatagacggatagactccatttctcctcttaaagatttcctcattttgaggggtcttggaattatttgagtgtttaatgaaagcaaagaacttcctccccagaggaattgatatatgcacaaagataacaccattttgtaccgtcactttagggttcacactttctggtacccatccttggacactatccatggccacccaggttaaaacttcttcttttctctttctttttctttcttctttttttttttttttttttttgagtcagggcccctctgttgttctggctggagtgcagtggtggcacacacacagcagctcactgcagccttaacgtcccaggctcaagcgatgttcctgcctcagccgcaaaaagagctggaattacatgcatgagctactgcgcctgaatctagacctatttagaaagttcaagtctgaacatttagtgatgccatagagagccctcccttcctgccagcattcattaaatgatggttttcactctgcagagcagcttccctccgctttccccagatagtctccctcccacctacatatgagaaaataaaatgttttcctgcatcactatgaaaaagagccctaaatcaatagcaaatcaagctatggaataaaagagtctttatggcccgagaaggtgattgctgaaggttgccatttagcagtattgggtttgtgtctccctggggtctccagcagcccagtgtctctgatgtgaggcacctttgcctacatgaaagtcagcccctctccccctcccccagtggagtgcagggagataagaattctgaaacaggtcagctgacgttgttttttaaaaaggttttgttctgggcaaatcctagccggatgtgactggtctgctcttttggtaccaatcctagcttgacagtgatccctttccagacataagcacctacaagtctcaggatggttttgctgcaagcagggggtaccatcccaatcatttctttaccccctacccttttttgtttcgttttgttttgttttgttttttgtttttgagatggagtcttgctctgttgcccaggctggagtgcagtggcgcagtctcagttcactgcagcctcaacttcccgggtacaagagattctcctgccttagcctcccgattagctgggattgcaggcatgcaccaccacatctggttcatttttttgtattttaaatacagacggggtttcaccatgttggccagtctggtcttgaactcctgacttgaagtgatccacctccctcggcctcccaaagtgctgagatgagaggcgtgagccatcacacctgggcttcttccccttttgccatgtgatttttttttcttgcacttaaagcaagtgcagaacctcatatgatgatctatatgcacttactgtgttttacccctctcggttatgttagtgggggtatttaggaaccatgctcattttctgggtgtttaatagctgaattctgtttcatttagatactgataagggtcttgaaatttaaaaaatgtatctttaagcttgacatctcccagtggtatggccctgtattagggagatataaaaatcatgtatgagtctccctatacctctctctgtttgtgttcccgcacacacactacttctccatggctcctccatatggccagtcctcttccttcatatacagcctagttctctgaggttcccatcccctcaagtccatgaccctctggcggagtagccgtagtggacaggtgcaccctccttcactaccttcctttctctgcaactagtcaccccatctgtgtccacagtttgatgactggctaggggctaagagtgctgtgattaaaactgctaacttcccacttcttttgactgttccaaatgggggcaagaatgaattttaaaatgaactttgcctgtcaaagcttgtctaggttaagggatgagcaatggcacagtgtcgtttaccccagagcatgaactgtttggtcctggttcaagccccttccccatttcccatgatactgggcctcacaatccatatgcaggaacagcagatgccacgtattgaaatttctagtttctctgccactaaaaatgatagctctgcttgcttgcaatatatgttgcctttgaaatgcacttgcagtgatggtctttcctatgcaagggcagagaagaaattgtctcatcagtatactttgctgaaccagctgaacccctcgcctacccagcagctctgtcacccccactgaggctggctttctagtgacgatgaacaaaggtggtcttcagctttctgatactagagagagctaggatgcataggccatcagagttaacttttgtatttctttcaggtcttcttgggtttctcattgaaacaaagcaagaagaataagcttatgatacccagcatattcttcagcactccagaaactcagaacccagcagataacgtaaaaataacaatgcggctgggtgcagtggctcatgcctgcaatcctggcagtttgcgaggctgaggcagacagatcacttgagcccaggagtgtgagattagcctgggacacatagtgagacccccaactctagtaaaaatacaaaaatatatccaaggatgtggcacatgcctgtagtcccagctacttgggaggtggaggtgggaggatcatctgaaccaggaggtcgaggttgcagtgagccatgtttgcgccattatactccagtctgggtgacagagtgataccctgcatcaaaataatgataaaaaagaacaacgacttttttttttttttttttttttgagatggcgtctccctctgttgcccaggctggagtgcagtggtgcaatctcggctcactgcaacctctgcctcccaggttcaagtgtttctcctaccccagcctcctgaatagctgggattgcaggtgcctgccaccatgactggctaatttttttttttatttattttttatttttttgtagttttagcagagacagggtttcaccatgttggccaggctggtcaggaactcctgacctcaagtgatccgcccacctcagcctcccaaagtgctgggattacaggcatgagccaccacacctggccctatttttaatttttttttcaacttttattttaggtttgagtggacatctgcaggtctgttacacaggtaaactgcatgttcctgaagtttggtagacaaatgatcctgtcacccaggtggtgggcgtagtacttggtagacggtttttcaaccccggccttcccactcccctgcatctcatagtctccagtgtcttttgctcttatcctgatgtccatgtgtactcaatggttagctcccacttacaagtgagaatatgtgatatttggttttctgttcctgcattaattcacttagattaatggcttccagctgcattcacgttgctgcaatgaacatgattttgttcttttttatggctgtatagtattccatgttgtgtatggaccacattttctttatcctatctgccattgatgggtatctaggttaatttcatgtctttgctatggtgaatagagctgcagtgaacatgtgagtgcgtgtgtctttttggtagaacgatttatttttctttgggcatatacccagtcatgggattgctgggttgaatggtagttctgtttaagccctttgagaaacctccaggctgctttcgccaggggctgaactaatttacattctcaccaacagtgtaaatgccttcctcaaggagtaatgcctagttagaaccttgcagtcacacaagaggtatacaaaggtaagagctgccacttcaagatcagaggccaaatgaaaaactttctctttagcagaacactcaagatgagcagacaaacctagtcacagccaatctctaggaagtgacgcacaattgacttaggaaaacaaagcaaaaaatgctgttctcagggctaactcagaggatttacaccaaatactgcctggggtctgttagatcaacaattaagatgaaaacaaaactttaaaacaaatggaagaagtttaaaggcacactctggcatgctcttggtattatttacaaaggagttttcctttcaatgttgtttataaggaaactccaagaagcctgattttagcatctatacaggccattatcatattaattttttgcattaaccaacactcccctcttttgaattttcacctcatcttaagttccttctctatgtattttaaaacctcttttgctgtttacatctcaacttcggatctttttcacacgccggcaggaggctgtatacatttaacatattaaggccgcagtgccgagttccctgaacagacaacatagctgtttgatcgagaatggagattttccaagtttgattttctaacaattcaccctttcccttgtacttgtgataaattccagttgtgtagtttaaatggtcattgaatagatgtgccgctctactctctacagttttaacatggttgaatgatctcaaaatgaggcaatcgtttgagcagaaacccgaagaggcctgggaggcagagctgcctgagactaatcctgagttcggcagccccaggcacttgccctcagacaggctctgagtatgtttgtagcaaagtgaccctcgggtcaccatcacctttttcattcttccttatgctcggagatagtcatctgactttgcatgtgcctaaaatcagtttagtctgatgcatttcatttcaagaaggcacaaagataggaaacctgaagccatagtattttgcttctttcctggcttagagaatgcgtcaagggaaggggccttctggtctaccaattctgcccttgttctttttttctaaaacatttcctttctcacagtgggagacagtctttgaaaacccaggtttccagacatggaagagagaaaccaagtattggaaatcatttcctactgcccagtttccccaattctcctccttcatgtttttttattcagagtcaagactgctggacttcctggtgctgttttgatctggtggaagagagagttgcaatatgactgtttgcttgttaaggagttggcagtagtcataccactcaggatgcagggtaaagagtcaagtctcttggttttatctctcaataatcataaaagtacatccattgatcccccactccattcccactggtgagagacttttgcttaagaccactgtctttcatggattggtgcaagcttcctgtggctctttctttttcttttctttctttcctttttttttttttttttttccccgacagggtctcattctatcacccagctgtagtacagtggtgcaatctcagctcagtgcaacctcctcctcccaggctcaaaagatcctctcaccccagcctcctgagtagctgggattacaggtgcacaccaccgtgcccagctatatgcccccgcaggcctcccaaagtgctaggattacaggcatgagccaccaggcttatcctcctgtggctctttccttccctctctacacccgcctctaccccattctgacaactgtagccccagtgacttttccattaagtaatgtctagccacattgcttcctactgaagactccccaaaggctcccagtcggagcacctcttccttaatgtagccctttctatctgacccctactcactgtctcatctaaactccagccacatcccgtggcttgttatttgcaaaatatgccatgtttttctcatactcagacttttatgtatggtatttcctctgctagaacccttctccacctctgttctgactcaacagagattacaactcttaggggaagctatctgtgaacctcctgccccagccaggttgcctgttcttccctctctctttccttgtgcttattccggtcatagggctttcatggtctgttgatgtttcctattagcagcctccttctgctagaacatgcacatccgaaggacaaaaaatatgttttatttacctattggctggcaaccatttaaatgtaagaggtaaaagagacgcctccacctatctgtacaaccttggctgtgtctcttaattctttatggacctctttgtatgtcttcacggttgtgtctatattagacagtgcccaccctacgttaatgccctatgatttgagattatttgagaacgtcatgaattggtccccgggctgtatttgaaaactgctgaatcacactccattgtgcaatgtcagccacaacttccaccattattaccactcaatggtggtaacaattccataaatgatgacaccatgaagaaagtaagggatggctaccgtgtgatcaactcttaacagatattttctctattacattacgtggctcactttcaggatattttcttctctattgacaacttaattctttacgactgctgtctcctccaggaagaattattgaaaagtaaagtgatgtttagaaagagataagtcaaagattgtttggatatcagctgttaactttttgcttcttacttgcaaaatagaatagaaccagcagtgttcactgcagcatttgtgggttattaataatttactcaatctattgatgcttgttaattgaagtcgctgagaaaagttagttaatgatgtgcctgcttacaccacattataattatgatggtagttcccctattattagggctgagtaggtgttcccattagaaaccttaatttctgagctgattgtcttcaccattttaaattacattgggccacatcttggcagacactttctgaaagcagatacgctcctttccaaaattatttttgtggtagcacagaagttctctccctcaaatgacagaggctgttaagtgtattctactttcaggaactgttttattaagctccaaccagcaatgtcctatgtaaacttatcccaaaagaaagatggttgctgaactagaggctaccttggcaaaaatcagatctcactgggaaagtaaatttttaaaagtcactcatagaatgggagatgggccacatttttcttgccttcacttggattcagaatggttctgattacagtcaacagaaaccaaattccaacgtatttaaactttatattttttgacagtgagatttattggctcatgaaattaggactgcaaaagatatgttgtcttcaagcagggcagggtaaaggggttaaactaatgtcactaatgtctttacttgttcgtcatccttcaactccctcctgagtgctgacttcattctggagcagatcttcttcacagggctacttgtagcctctagaccagcactccccaacctttttggcattagggactggtttcatggaagacaattttttccagggatgggaaaatggagggaatgatttcaggatgatttaagtcctttacatttattgtgcactttatttctattattattacattgtaatatataatgaaataattacacaactcaccataatgtagaatcagtgggaagcctgaccttgttttcctgcaactagacagtcccatcttggggtgatggtaggaagtgacagatcatcaggcattagattctcataagccacatgcaacctagctccttcgcatgcacagttcacaagaggatttctgctcctatgagaatgtaatgctgctgccgatctgacaggaggtggtaatgtgagctatggggaatggctgtaaatatagatgaagctttgcttgctcacctgctgcttacctcctgctgtgtggcctggtttctaacagaccatggactggtactaggccatcgcctgaggtttatggacccctgctctagagtatattgttgacagtccctgtattgaagcaaagcaaaaccttctcacacatgggttccatatataaaacaaaagaaggtgtcaattctgtttggatcacatcctcacccctgagctgattcttggagttagaaggagagtgaattttgatttccagtctataccatgcgtccatagcggtagcacaagtaggctgtgcatagctttagtaaacccacccatggaaagtattctatcagtggaaagagagatgttgctaccagaaaaactacagaagggataatggacaaaaattaaattataaatttactactccatggttgcatccagtacctaatcccaacccttggctgacccgatagccaaagaaattgccatcaattgttaatggttatcatagttcaaaactccattaaagattttatttcaactaggatctttaaaaattgtggccttatggtctggtgctaccaaagagttagctgtgcaatcttgataaagataggcagttaggttcactggatttcatttgcatcattgatagtggcttctctgtggtgtctgtcttattggaaagatgtgagtctggtatgcgcagatgtcagtgaaaaggaatttattttgctttggaaatgcagcatgggcaaaataagttgtgtcctggttatcttgactcctggaaaaatagtttagaattgttcctaatggggtccaggtacgatattttatgtctaagcatggtggaccattttccctccctagaagagacaatggaaggtgggtggcaccgagtcttgcatgaaggcacttaatcatttgcaagactcaagtggacataaaaatgcaacagagatgttttctgagaacaaacaaaatctaggcaaggagggaaccaaggagtggccattgctggtgcataaaacctatttattcttatgaaagagagtgtgttcatttgtgattctaatatatttttttgtttgtcatttggttaattatgtagaaccatggcatggtctaatattttgtacaaaacttgtctcttaatgttataatctggctggagagaaaaattaaagcagctgaatatcctcctttcctcctgttatgaatccgtctgtgtcactggtggacataatcattttttttttaaattctgcaataactcaactttgagtctggtaatgtctctatcaaatgcatacctggaggcatgggtcagaatctcctgaactttttcatgtttattgatttatttcatttgataaacatgatctgatttactctgtggccaaactataaatgcaaccttttattttagtctttccttcctgtcccaccttccaggaaaaatttggtttagggagggaggacatgtattggattgaaaggacatctgttggccgggcaaggtggctcacgtctgtaatcccagcactttgggaggctgcggcaagtgaatcacaaggtcaagagatcgagaccatcctggccaaatagtgaaaccccatctctactgaaaaaacaaaaattagccaggcatggtgatggtggtggggggaggggggcgcctataattccagctacttgggaggctgaggcaggagaatcgctggaaccctgaagtcggaggttgcattgaactctagcctggtgacagtgagacagtgtctcaaaaaaaaaaaaaataaggaaagaaagaaaggaaaggacatgtgttttattgttctgcttgttttcagttatcatgagggggaaaagtaccatgaggaagatgccctcaaacaggctatcagatgtttttgttcttgataccaggcaggaaagagatagaggtaaattgttctagttaggcattaaacctggttttaaaaaaaacccttttaaatgacgagaatggagataaagagaaaaagcattctgttgacatctgtgtggatttgattctcaatttatccatcatcattatcatagttgtttttgttactagtatttagcaacagatttgcttaaataatgggctagaacttacaggggaatattagcaggtagaaaagcactcaagattgtttttgcacatcatagttcatcatccaaaagttatttgttgagcacctatgatgtgccaagtgttgtgagactaagaaataaccaggatcatgttactgccttggaggatcttcattcagtcggaggaagacatggcagagatacttagttacaagctctagtgctgtaaaagagacaagtgaaagatacagaggaaagggaatcactcatccatctctgcctgggagattagaaaaactaccactgaagagtgtgacacacatttcatgtgaatgtgggaggaagtttgaaagatatggtcccatcacagaaggacaatagatctttcctaagatttacctgacaagaggtcatttgcttgaatctgctcagtgacaggaccttcctacaaggcagccatttttgcaggccttgagttgttagatagtcttcctcttgttaaaactatttatatttaaacttgaaggcatttagaagatactgaaaatagtgggcagttgtaagaaaatgtgattggagaggcataaaacttagtttgggaaatggctagaccctcttcctttgtgtgtgtgtgtgtgtgtgtgtgtgtgtgtgtgtgtgtgtgtgtgtgaatatttgcatgtaccacatgttgtatacatggagcatcagtgagtatgggatacatattttaccaaatgctttatgagtattatttaatgttttcaacaactgtatgaagtttgaagtttgtattgttatgaaacccacttcataggtaaggaaactaggattacagagttttataactttgcataatgagtgagagaatagggatgttaacttttctttaaataactgtatcctcagaataatattttgacttgaattaggtagattctgtacagtataaattgctattgagctggaatattttgtgtggcggagggcatcttatgtgtgtgtgtttcttcaaggtatcaatgcaaactctccaaagcctcttgtttcagaaagataaacaactgttatcagcctacagatttttgaagaggctgagtactaccacaagatttattttaaaatcaagctgaaacaaagtttttagctttttaaaaaaattaattttgagagagtgaacttcatatcatcacctttagagttccagaatagcaagtcttgagaaaggaatcgagagttggaggattggccaggtacagtggctacttgtgatcctggcactttgggaggtcgagttcagtgggtcacttaagccaggagttcaaaaccagcctgggatacatggaaaaactccatatctacataaaatgataataatagaaaatagcaaggcatggtggtatgcacttgtagtctcagctccttgggaggctaaaatgggaggattgcttgagctcgggagttgtaggttgccatgactggagattgcaccactgccctccagcttgggtaacagggtgagcacttgtctgaaaaaaaaaaaagagtagtggaataagagaaataccaatattcccaggaattgggccatggaagagctatcagccacttgccttcctcccttctcctcccaccaaaaaaaaaaaaaaatatatatatatatatatatatatatacacacacacacacacacacacacacatatatatacagacacatatataatcattcagctattctaatatttgtatatgtaaatgtgctctatataatacctatatatgtgatgaaccatatgtagtggtcataaaattggatataaattttatgtctctataactggacattaaatctcattcctataccccattaaaaactgatctatttttccaggagccaaaataactatgtaatatacagatatgttttatatatatatctacacacacactcacacatacacacacgcacacaggtatataggtatacatgtagatagagtttcaccatgttgctcagggtggtctcaaactcctgggcttaagcaatctgcccactttggccttcaaggtgctgggatcacaagtgtgaccactgtgcctggccgatccctcaactcttgattcctttctcaagacttgctactctggaagtccatatatatatatacacacacatatatatgtatacatatgtatgtgtacatgtacatgtacatatacatgtagatataggtagtgtattatacatatatagacttgcagcatatgtatatacatatctgtacatatacatgcacatatacatatgcgtgtacatatatgcacacatacatgtacatatatgtgtgcgtatagttgtacatacacatgtagatatgcatatatgtgtacatatacatgcacatatacaggtagatacacatctatgtgtgcatatacatgtacacatgcatgtagatatatatgtgtacatatgcatgtagatatacatatgtgtacatatgtatgcacatttgcatgcagatatacatatatgtgtacatatatatgtatatacatatgctggaagtctatgtataatacactacatttaatttttaatagttttagtagttctatagtattcccttctatgagtgagacatttaatggattccttattgatgcatgttaaatggcttgagttttgttgcttttctacttcaaacactgcatctgtgtatacttctatctctctgtacttgtacatgcacaattataggataatttcttatttaatggctagatcgatttacttttcatagatattgctaatatttgccctccaagaaagttttatccgtttacattcctataatatatgtgataacctgttctctttacagcaaaaagtgcctttaaaaaaacacttcccttataacaaacatacatcctctgctgtcagattgtgaaaggctgaaggaaatttacaaggagctctcctgtttttcccctattatacttgattatgctactaaatattcagccacttccatgctattgagtgtgggagaaagcaatcgtattctcattggcacaggataagggaagcaaactcacctgagcatcgtttcagccttagaattgcaggctggaaagcctctccttgtgtgtgtgcattggctggcagctgcctgccatgaatgctacccaggctctcaaaatgggaagaagaccatatgcttgattactaaatgaattcacaggacaaactatcacagaaaacatgtgtaatatgagataccatttcaatttggcaataaatgtatggtaaatggaaggttgcagcccatgtaaaatgcacttaggatctagtgttgccatggagtcaaaggaaatgttatggcagcagataggtgcaattctgccctggaatttggcactctgggattcgttgggggcctgtggaactattcagaatccagtgaacaccaaccatggggctttgcatagcttaagtccaggcacgtgaaaatatccgaatagggtctgggagctctgaatttcaaatatcattggttatttgatctaaactggattaaggtggtggaaatgacagtatctctacacgccatagccactctacatgcagtcccacgcatcacctcattttgtggtcactgcagctcttcactgggcaagtggaaacagcttcacaaaaatcagactctaggcaagaaattggatttacatgttttccctttggttttaaagaaaatgtagataaaaatctgatagtctacttcagggaggacaaatatatttcagcttctctgttcactttgacccattggtagagacttccgaggagctgtgtttgctttttcttaattaagcatttaatgttgagatgattttagatttgtagattgacaaaaagctgtaagaaataatacagaaaaattctatgtagcttttactcaggtttatccaatagtaacatcttgaaaaactacagggttggctgggcgcggtagctcaagcctgtaattccagcattttgggaggacaaggtgggcggatcacaaggtcaggagttcgagaacagcctggccaacatggtgaaaccctgtctctataaaaatacaaaaattagccgagcgtgccggtgggctcctgtaatcccagctacttaggaggctgaggcaggagaatcacttgaaactggaaggcggaggttgcagtgagctgagatcacatcactgcactctaccctggtcaacaagagtgaactctgtctcaaaagaaaaagaaaaactacagggttagggttatcacaaccagtgattgatcttactgatgtagaaagatatactggtcttatacagacattgataccacctactgatgcaatctcctgacctttttcagatttccctagttaaatttgtactcctgtgggatgtatgtttgtctgtgtgatgtgtgtgtgtttactgtgtgtatctatgtctgtgtggtgtgtgtttgtgtggtgtgtatgtgcctgtgtcctgtgaccatgtgtttgtatgatgtgtctgcatgtgtgtgttttgtggtgtgtctatggtgcgtgcacgcacgtatgtgtgtatggtgtgtctgtgtgtttgtgtggtgcatatgtgtgcatgcatctgtttggtgtgtgttgtttctgggtggtgtgtgcatgtctgtgagtagtgtgtgtgtctgcatgcatatgcgtttgtgtggtgtttgtgtctctagtgtcagcacttgtttgtatggtatgtgtgtgtgcatgtgtgtgtatggtttctgtggtgtgtctttgcacacgtgtgtgtaattatttgtattacaaacatttatcacttgtgtagtttcatgtggccaccaacacagtgaagatatacaacagttccatcaccacaaggatccctcagattccccccatttctctcacccctacccccgtccctacctgctggcaaccactaacctgttcttcacttctgaagttctatcatatcaagaatattatataaatggtatcatacaggatgtaacctttggagactggcttctttttctctgcatactgccctggagattgtttcaagttgttgcatgtgctaatagttgattgtcttagattgctgagtagtattctatggtgtcaatctaccacccaagaatcttttttcagtagacaccctgaggctgagcaggagagggtgccattgtcactgcgtcatgcctatcccagagacagggattgagaggggtggcaagcccctggtgaacctgcttggcttacatgtatgtgctgatatttgaaagagaatcagaaacgggacaggattagcatctatgtcactctagagatcagtatccaggattcagaagggtcatgagggctgtcactaaggggactagtgataggctggaaatcacgctccatgcgctaggactatagcttccatggcagaaggcaggatttgaacatgagtccccagccactttttcagtgatctctctactccgctatagcttcagtcatctcccgcttatcgtgtgtgtttgtgctggttctggagagcgcacaatttgcagaaggcagttttgtttggatctgccaagtacaaatgtggctggctagtctgttggatagcctgacaagacccagaaatttctgtctttcctccctcccatcaaataactgggctcctccaagagccaacgcatacatcccacctgtaccaacagaatgttgtagtttgcatacttggaatggaaaaataatatttggcttggctttgatcatatatactaattattgctaatataggcaccagatgattgcattttattatacctttgtttttcactaaatatcagaattccttccttgaggggggagttgtcatactacttaattgttttgtgttttcttgacatatctaagcattatctgtgcaactgtgtcagtgtgcctgttgctgtaaatattcaagggactcataacagtattagaactaatttcttaccacaacagaatattatccctttcataattttcaattgtttcaaaggaattctgaggattcttggtttccaaacttcatatgacttttgactttttttttttttaataaagtacagcaaagagttttatgactatgtgctttagaggccagatggcattgttttcttcctgtctttggcaggtttcaggcaagttgcattagtcttctggactttgactgcctagtgtgtaaaatggcaatgaaaaagtaaacgaataaaccagactttgtttcttcttctcttctgtacttttcatcttcttcctcctcccttttccttccttctttcgtaaggttgcacaaaataatgtacattaaatgtgtaacgtgcagcatgaactacattttatacatatagataaaaactgttatacatatttttttatttgtgtcattaacttgttcttgttgattcaatgaagattacctgcagttagctgaaaagtcgtaatacaaacaattattttatggctttcttttttcagtatgatttacactgtccagttatgtctttttgaggcataatcttcatcttagttttcctggggggtttttctgtaactcctgtgctacattttcaggcagtttcttaacataggtacctatgtctattcctcctcctcctccgcctcccccttttttctccctcctccgtctccccctttcttctccctcctccctcctccctcctccttcctcctcctcctcctcctccttctttttcttcgttcaatcttggaagctttccaattcaactctaacttcttcagcccgtcttttacttatgtgtagctaataccacatttatatcagcgacaaaccttcaatggttaggaaaaagaagctaaccctttattttctctttagatgtgttggtccatttgttgtcagtgttttggttcaggttgttcccagctacccagatgactacctttcatcatatttgcagagtgtatttagtgtttacatcaagaccaacctctgggattacaaaataattttataccactttctatctctgggtgattggaagtggctatctgcagcaggactatgtggatgatgatgaggtcataggcaggttcgtggagaaagagtgctatgattgattaatgatgtctgctgtgaccatgagataggggaatgcagtatgtgtaaggaatatttgctaaccgttttaaatgaatgttctttatgcttttagcattgctttaaaatggataacaaaattcatcatatatttgctaaatacacattatacctaagtgtataaataacatttatacctaagtgtgaggcacttgaaaaactcttctagtcattattgcctgtaattctttcttcactcttaggggttaggaatcatttttaattcctattttacagattcagaaagagaggtacatgtcagtgaagtcctttgctaaggctgtgtacctactaagaatcagatttaatgtttgaatctcggctaagtaatcccagggagctttctatggaggtaaggaagaggatcaggttcacaaatgcagaaataagtgagtttttctagtgagggtttctgtccttcatttgagcagcttcctttatgactcatctttctagaatcttgcaagaatacaaaccaacatttatagaggtgatttcagcacaagcactggatgtttagaagtttctagtcagtcctaaagtgagaagacagaacacgttcaattgatttccatttgcagtgcccagaatgagaaaggtgatgtttattctccctggtaaacacactcaaaggttttggggttacccaagttgagctttccaggcaatgaaccactaaaaacatatttgttcccagaacacagccagctagtaaggttttcccactggggctgacatttactgtaacaagagcctgtttccttctctcagagctgcagccagctcctcacaagggagttggtgtcttgccagagaaacccctctaagctccaagagacgtgccagggaagccagtgcttttccctttagctgaatgtgccaataatggcagaatgatgtctgctttttaaagtgacaagttaaaatattatctacaatttatctgtccactcatccatcatctacttatatttcctctctctccatatgtatatatatgtatacacacatacatgcacacatatgtatgtatatatctatttggcgaaatgaatatatttgctcatttaatatcacagtaattctataaatataatttagcaaattttatgatgctccattgtgcaggttctaaaaatgataaaagaatctagacttctgggcgcagtaactcacgcctgtaaccccagcactttgagaggttgagggggatagatcacctgaggtcaggagtttgagaccagcctggccaacatggtgaaaccctgtctctactaaaaaaaaaaaaaaaaaaacattgccaggtacgcgcctgtaatcccagctactggggaggctgaggcaggagaatggcttgaacctgggagacagaggttgcagtgagctgagattgcgccactgcactccaccctgggtaacagagtgagaccgtagctcaaaaaaaaataatccagatttcatgatttctagataaatacaaggcaaattgaaaacagctctcctcctcctcctctttctccttcttcctcatcttttgttgttaaagaattatagacttcaaagctggagaagcagtgtggggtattccctggtcctccttccaaatgcatgttgaaatgaagacatgtgggttttcttcccgttttggccatcacctgacctaatgaccttgggccagtcacctggcatctccacgatcctgttacattgcatataaatgcagacttctttgtatgatgtctaaggtcacagagcaggtattatgcccatcttgtttatctgccaagcacagtagggcacccataaataattcctaagttactgaatgcatctgcagctcaacacttttgacatttttttttctcattttaatattggccaactgagatttgaaaaggttttgacttgcctgagttaaagcagggggagtctactggccaatttcttttgactattacgttgtttgatttggacgaaggggcagggggttgtataaacgtcactgtggagagcccttgtcccctggtgatgagtaaccttatcaatccagagcaaagaggcatgtgaggagattttgctttggaaaatggcacacagttgaggaaatttcatcaatgtgtatgaagcggctggtctggtgacgttttgctttgcaagtgggtgactgacatccttcaccctctgatctgcccattctctcctttggtccttctgttcccgttagcactccctttaacatcagtctctctccctcttcttccacctagaatctcaataagctctttcatcatctcagtttctacagagcagaataagctgaggacttttttttcaagttttatttatgtgtttttctgtttttttaatttaaaaatttaatttttttagacagtcttgctctgtcacccatgctggagtgcagtggtgcaatctcatctcactgcaacctctgcctcgtgggttcaagcgaatctcccacctcagtctttcaagtagctgggactgtaggcgcatgccaccacacccagctaatttttgtattgtttttggtagagatgaagttttaccatgttggccaggctggtatcgaactcctgacctcaaatgatccatccacttcagcctcccaaagtactgggattacaggtgtgagccaccgcacacagcctgttttttctaattttaatttcagcaggtttttggagaacaggaggtgtttggttacacgaataagttctttagtggtgatttctgagattttggtgcactcttcactaaagcagtgtacactgtacccagtgtgtagtcttttctccctcaccccctcccaccctttacccagagtccccagaatccactgtatcattcttacgtctttgcgtcctcatagcttagcccccacatatgagtgagaacatatgatgtttgcttttccattcctgagttacttcacctagaataatggttttcagctccatccaggttgctgcaaatgccattattttgttcctttttatggctgaatagtattccatggtctgtatataccacattttcttgatccactcattggctaatgggcatttgggctggttccatatttttgcaattacaaatagtgctgctataaacatacgtctacaagtgtcttttttgtatagtgatttcttttcctctgggtgaatagccagtagtgggattgctggcagaaatgatatgtgtcttttgcaaaaatccaaaccagaaaagagtaaaatttatatactatgtgtgaaaagccccctctaaatcctcttgtctagagaaaaccacttttaataacgtgtaatttcttttctgtgtatacacacacacaaatacaaacacacacaatgacatttcaaaatcgtgtgcacatcacatttctattcagttttcccctacctcatggctgtatagaagtctgttgttaaggtggtattataatttaatcaaaaatccaccttctgatcaactaagttgttctcaaccttttgcttttaaaaacattgctgttgtacttctttgtagacattgtcaggtaactgcaggagaggcaataaattttaaatggataagagaatgaattgtttgcttcttgaattaatgctttgaatcatcaactggaataggatatggagttggcagcgtgtatcacagtaacctctccctgaatttggagccctataaaacaagttgtgataatttcagtcatttcagaaaagcttctgggtcataaaggagagctactattccaaattcccacctttgtctttggtagccaaggatgcaatcctgtcagtagtcatccattttcgcaggtatctgctgggtccctacttgtgttgaatatcatgtcaaaaactgagcaggaagggattagcaagacagtctctatctctgccacaggtgtgacatgcagtcgtgaggttgtgcattgctccaagatgcctaagcaagggggcagagagggtgacacaccttgctcacaagccatgcaccctggaatgggctgtgcccacccagggtgaaaaaatggacttaatggctactagaggcccagatcataactcttctgtaataataataataataataatgataataatcattattattattattattttaccatttgagatggagtttcgctcttgttccccaggctggagtgcaatggcatgatctcggctcaccgcaccctccacctcctggaatcaagccattcacctgcctcagcctcctgagtagctgggattacgggcatgcaccaccacgcccggctaattttgtatttttagtagagatgaagtttctccacgttggtcaggctggtctcaaactcccgatctcaggtgatctgcctgcctcagccttccaaagtgttgggattacaagtgagagccactgtgcctagctcctctcctggaatgattagatttaactttgttctccaattcttagacctgtgactctgaatagggtggggatgttcatcttgatttgccttctgctagaccaggaatgaagagatggatgatattactccttttgatgtttttattcttgaatagatatgttggattctctgtctcttgccccctgcaccccaccgcatgcacatacacacacacacacacacacacacacacacacatacatacatacaccccagatttcctttgaaggagtgcatagtctatttttgttgttgttgttgttgaggtggaatctcattctgttgcccaggttggagtgcagtggattgatctcagcccactgtaacttctgcctccgggattcaagtgattctcctgcttcagccttccgagtagatgggattacaggtgcatgccagcacacccagctaatttttgtattgtcagtggagatggggttttgccatgtaggccaggctggtctcgaattcctatcctcaagtgatccacccttgtcggacttcccaagtgctgggattataggcgtgaaccaccgcacccggccggagtgggtagtctttattcaagaaaattcccaaatcagcaaatagcttgtgagcttacaggtgaggttctgagggagtgggttgtaaggaaagatagaaaactatagaggagtccatgaataaatgtgattcagaggggagggggaatatgaaagagaagaacagggtgggtaggaagatcagaggttggagaagaaggaacaggatggcctcaaagaagcctagagctgaggtggccagagcatggttaaggacagcctcgtcatcggttatgggctgtgtgccttgttgttgtcatggactggccctccttcgacacccctgagcagtctggtgaggaaggggtgagtgtaaaccatctttgccccagtctgctgtcagccgatgcactaggatgactctaaccggcatgtcaaggcagacttcagcagcatccttggatgagtgcgcactgggtggatacaggacagacagccaaaggagtgctgctccaacccatgcggcatctctcccaggttgtgaaacaactcgggggtggtgcaggatccacgctggggactgcacagacacagccaccagtagccttgctctcatttgagtttttctttctttactgatgacatcagagagaaagccccagattgctgcattggtgttctttttttttttttttttttttttttttttttttttgacagtttctttctgtcgcccaggttggagtgcagtggtgtgatctcagctcgctgcaacctccgtcccctgggttcaagcgattctcctgcctcagcctcctgagtagctgagactacaggtgcctgtcatcatacgtggctaatttttgtgtttttagtagagaagggatttctccgtgttggccaggctggtctcaaactcctgaccttaagtgatctgccagcttctgcctaccaaagtgctgggattacaggtgtgagccaccacacctggctgaaaataggatttttacggatgtcactcattaaggatctctaggtgaaatcatcctggacttagagtggaccctaagtccagtggctggtgtttcaataagagaaatggagggagatttgaaaacacagagactcagaggagaaggccacgtgaagaccaaactagagctaagagtgatgcagccacaagccaaggatgccaggaccaccagaaactggaaggaacaagaaagaccctcccatgcagtctttggagggagtgcgaccccgccagtaccttgctttaggatttctggcctccagaactgacagagaatacatttcttttgtttcaagccacagtttttgataagttgttactgcagccctaggaaactaattcactagagggctgcaaactaaggcctgagagccaaatccagcctgacacctgtttttgtagattttattgacagaaacacagccttattcatttacgtattgtctatggctgctttcactctgcaagggcagagttgaataactgcgacaaaaaccatctggcctgcaaagcctaaaatatttactatctggccctctgcgaaaaaagtgtgccaaccgctcttctagggaggtgtttaatttatgtgcttgtctggggatgctgcggggtaggggatgtttgtagtgagagtctgtctttaacagcgcagaaccacacaaggtaaggattttttttaaacttacatttcaatttttatgaagcaggttttttcctccttagaggaaaaacatgaaatgttccagaatagttgacagcattagctacatttaaaagattcaaggaagcaaaatggttttccgtctgttgaatcagtcagcattaaagttcacttatcaatgatggcttttctatgagcagcagctttgtattaaaatggctaatgggaatgtggttcccctagcaagctttggtttgatctagaatttttggagagtctgagtgggttttcttcttctcagcatgaaatggaccaaggtctgttttgcagctgagacataaaggaagtgaaaccttgtctgatatgtgctagggtgcagagccaggtaggaaatgggaaagagtgtacctcaaacctcaacagccacattgtccaccaattctcattgcatgtgaattcgtgaacctcattggcgagctcaaagaggtggctataggaaacctaattataagcatcatttggctcatactggtacagaaaaccttcaattaagttgcagaaaaatggccacacacagaagaaagaagttagaagggtttttctggtattcttggtttacatctcagtggaagcaatttttatgtcttctgcatatttcactgagaagcctccaccacttctagccataacttcctttccttcctgttacaaattttcttcctagatttactcttcagtccctaaaaatatccataacacattatttattcactccataatgtacaccatccaaatacaacaattttgccaataaactgttattctaatgaataattcatgcagtcttcattctcctgacatgaacaaatatactttcaaataggaggagtgtgcctctatttttgtcttaactccatttcttaatgtcatatatatttttaaaggtttgtgatgtccttccttggatgaactccatggggaataattctgatactctaattaagagcaataaactatagcacagaaatataactagatttatagacagtgtttgttacagtgacagtgtagtttgcatgtggagggaggaagtaggcaaatcattcagtgtctcagggcaggaaaaatgtgaagttctcacctattaagaaggcaacaccaataattgtttcaaattttgacaatattcatggccatagtttcctcatatttatatgaacaggatgtgatgataatggtgacgatgaaaatcataataacatattattatgtgatgtaatgctaagaattttgagtttctatgagatactagccatttactaaaagctttgcatatatcagggtttctgaatctcagcactatgggtatattgggtcagataattacttgttatgggccaggggttgggggatccactgtgcatttgcacgatgtttaacggaatccctgacctagggtatctgctagattcagtagcacctgcctcttcaagttgtcacactgagaaatgtctatagacatggcctaatgtccccaggagggtaaaatccccttgtagaaaaacagtgatgtacatgattaattgcatcttcaacacattcctaccaggtaggtgcattatcagtcccatttaccagtgaagaaacagaaattcagagtgaatgacagaaccaaattttggtgcagggtttactactacaccaatgtcaagactattttgttgcatatgatgatacagagcattaattcatctgccttctcctcttacatgggtattttcacattttaaaaatgtataattgcagggtgcagtggctcatgcctgtaatccctgcactttggcagggccaaagcaggctgatcgcttgagtccaggagttcaagacctgccctggcaacgtggcaagaccctatctctacaaaaaaaataaaaaaaatagctgggcatggtgacacacgcctgtggtcccagctacttgggaggatcaggtaggaggatcacttgagcctggggaggcagaggttgcagtgaaccaagattgtgccaatgcactctagcctaggtgatagaggaagaccctgtctcaaaataaataaataaataaataagtatttggtgtatgcatgctgggtaattaatatatcttatgttttgcacagacagaacttcaaatttccaaaaccccttttatagaaactgtagcatgatgaccagattaatactttttaaaacaatagcaataataacagtaacaatttatcctcctgctcctcaccactgttaattgagcactctgtttttagagatggtgtcttgctctgtctttcagactggagtgcagtggagcagtcacagctcactgccgcttgaactcctgggtgcaagtgatactctcacctcagcctcctgagtagctgagactacaggcacaggtcaccacacccagctaattaaaattcttttttttttccaagatagagtcttggcgtgttgcccatattggtctcaaattcctcagctcaagtatgagtagatgggattgcaagtgcgagccaccacttctggctaatttagcactttccatgtgagaaactaaaggatttgactggatcacctgtttaattctcacatcttagaggtacccactttgggtatcttttagccctaagctgtataattcagagttgttttgttttctttgggtttggtttctgctgtatcctcacatacagtgaagtttccatacaccttggttgaatgaatgtcttcatgagcagctacagtcttagggaaaacatgtagcttattaaggtggtgacagagcttccacttaaatccaggagatcccttgcccttaaatcctctgctgtctgctctgcgcagttgagggtttcatcaaaacgtccagctctgctctcagccatctggttgggtctgtcttttatgactttatttgtatatcaggtttccttttgcaggtgatcctaaaacacacactctcccgtcttgctccagtctgctcaccctctgcctctcacctgcgatgtctccttcatttccatttgtctgaatcttatttcttgttggaggtccagctccatcccagctttcttcccaaaccctctccctatgtcttgggcactctcaaggccttacttgccaccattgccagtcggcaattggcgaggagctgcacaaatcacaggcacccagtactaactcccaggtctaaccctccatgaactatgctcttaggaaagcagcttaaagtccttgaaaccccaatttcctcatccctatgatgaggactgcagtgtcattgtacatcccaatttgctgtgagggttcagtgggaaaatgcttagctgagcacttgacacatagtattttcttgatgaattcctgccaccgctaatgtcactttatccctgttttgtatgttccctggttgctttatgtatgtgtgcttttgaactagattgcaggattatagaaagagatttctttcagtgtgaatccttaatgtgacacaaaattcagcacaaggggtaaaactgtggccaagaggccgcctcagtgtttagaatgtaattttctctctttatgttctgaaccgtggtgtctttatcaatgacatggaaggggccatttccatttacttcaccatgccagaagggccattgcaaatggatttagttatagggtaagcaatgagcttgtgttttctgaacagctaagcctcagaactgtaataactcattatcaatctgtctccatacttcatcaaagttcccaggtgctttgaattttggcttggccattgtctttttttagctataaaattttgcttatcgcatagtttaaagtgggatgatgactgagacacatctctgcttatgagtaccacttaagagaggatatatcctcaggtagaacaatttccagagaggagatgtgggcacggggtctgtgcctgccctggaagctgtgtagtatagtaggaagaatcctacattcacagagaggctgatttttgcttccagttttgtcacaattcacatgatattgggcaatttagaaaaaaatattgatttgctttaacgttctcatctgtaaaatgaaacatcccaattagataagttataaatgacctttcatttttagaattctgcatcctggaattaaagtgcattggaatgagccaataattccatattttcttatattacctaaaatccacatactcttcaataaatttaccaccatagggttttcaaaccccatcaaaaaaaccacttctttcatgtaaatgcccagcagtttatctctttttactcctcagtaccctacacatcttcctaataaagtatataataaaagtaaatcttcccactagtgtgtttatagtgtgaaacacattgttattcccaccatggcagtggtggataaaatatacatatttctctgtctcccacaaccaccctttgatccccagccttttatcagcaaatccaaagtgctaccttctgcaaattagcactacctcctgagaaattgtgccaagttccattaaatgtaattagcattcctgttgtttccttcatattggagaaaaaaaaaagaaaactctctcttacttactgggaacacacatcatgccaagttgtagcaacagaggcagcacaaggctgaaagcaggaggcagagggggatcttgacacacaatgatgagttcacctacatgggggctcaggtggcagacacagaggtgtcagtcttggcttttaaaagtaaaagttggcttcccaatgtagagttaaacagatggcagagtgccttctgaagtgagggtttagagaacatggggagatggttatctgcctcaatttgaaactgacctgccatgagattcccaaggaagagacttgaatatcctagagcagttaactacaaaactaaaatttgccccctcagtatggttttcgtgtaaaagaattgcaaaacaaagaaaaactaccacgtgtgtattttccctagaatttcctggtagaaataagatattagtacccaacaagtagaaaagaatatgagttcagaagaaagactagggtttagtatcagacatactttttgattattcatatttcataaaatcttattttcttgacttataacaaaaatcatacaactgttttattattaacgtaaaattaaagaaaaacatcactacttttctcctcccccttttatttcaaattacgccactgactacgaaaacctggtcaaatccaacgtgcatttagaaaccataatttgaagaaactaatagctggagctcagtgccaccatccacaacagatgtccttccaaactccattcactgtcatgctataaaacagaattcagaaacaacagggtatacgtatatatctgtgcattcagtgactctgaaagggaggcactggtttcgaatgttttgtgtgaacacgagttccatttgacacttttttttttctctcagaagtcattttgtctcattccttgcttacttcattgtatttcagcatttgtcatctcaattacagtagtgcatactacttttacacttcaactgcaatattcagaaacaccagggaaagagcagtaaagatattaggaggtggtaattaagactgagaatggctccagaagggtggaaacacatttaggatgttttttattttaatcatctgtaaagaaactaattccataggcccatctacagttaagttccacttgcagcacaaagcatcataaattgaatagtaatattctttatcccaatgtcatacaactgttgtcctataatactgtgacgttgaatcataagacacacgttaaataacctattatgctcagtggtttctctgacagttgaggatgagaccaaaacgtatcccaccctgggtgacgcagagaaacgaaatgaaagacaaaccatttggtcttccaagaaagagttcagtcaatcacagtgaactggttggagtatattcattaaacaaatatttattgagcatctgctttgtgttaaatgctgaatggtgatttaagctctagatttgcctttcctggacaggttgtagaaataaatccacacaatgtgtgatctgcatctggattatttaatttagcagaaagtttatccatgataaacttttttttttcgtgaacatgaggatgaacatgaggttcatccatgtggatgcatgtatcactactttgtttctttattattgagtaatattccatggtatggatggaccacattttgtttatccatttacccatttattgatggatacgtggattgtttccagattttaactattatgtagaatgttactatgaacacttgtttccaagttcttgggtggatatatgctttcacctttcttgggtagatatttaggagtggaattgctgggttgtatggtaagtttaagtttgagcttaagaaaccactaaactggctgggcgcagtggctcacacctgcaatcccagccctttgggaggcagaggcaggccaatcacttgaggtcaggagtttgagattaacctggtgtaggtggtgaaaccccatctctactaaaaatacaaaattagccaggcgtggtggtgggtacctgtaatcccagctactcgggagtctgaggcaggagaatcacttgaacgcgagaggcggagattgcagtgagccaagattgcgccattgcactccagactgggagacaaagcgagactcagtctcaaaacaaacagacaaacaaaacaaacaaaccattaaagtatttttccaaagcggttgcgttattcaatatccccaccagcaacatacaagcatccaggttgtgccacatccttgacaactatttgtattacttatctatctttcaaattactgccattctagtgggtatgtggtgatatctcatcatcatggctttaatttgcattttcctgatgtctaatgatgttgagcatcttttcaggtgcatgatctttatgtttgtttattttttatttttaattctggggtacatgtgcaggatgtgcacgtttgttacataggtaaatgtatgtcttggtggtttgctgcacctatcaacccatcacctcggtattaagcccagcatgcattagctctttttcctaatactcttcctcctatccaccccagcccccaataggccccagtgtgtgttgttcctctccctgtgcccatgtattttcatttttcagctcccacttataagtgagaacaaagtgcatgatctttcaatgaaataaccttcttcgcctgtgaaatgggtctcagtgaatcttgaggaatcttacattactacctataatttcctttcccttataagtcagcaaaggcatgggcaggggcctgaagtgggagaaagagctcctccccctttaacgtggattcagaaatgtgtgacagggagctgagactttcgctgcctggtcatactcattgagcctatgggctggttgtgtgaacatgccacaggtaggcacatagggctcataggcaaaggatcccatttgtgcataaggcacactttgaaaggtagggtttggatccattatctcaccccaacagctgtgtgcctccagtgtgcagcttgaaagccacgtgttaccctgtcagttcaagcttcccgaggttacctcttccagccacgcagtagttggtattatttctttcatttttttgataaaatgtcttcctctctccttctcagagtaaagcaagtctctgcacatgtttctcagctgggttgcagtaatctaggaaaaggtcactctttagaggagttgaaaggactccaggttcttatattagccctctgagcatataaaggcccaaagaaacagacaccaattcctctgctgcacagacttttaaacctggaaagctgtaaatgcagaaacttaagtatctgggaggtgcgtgcttagcagccatccgatgtgagtgtcagttcattttgacatgtaaccaagatggacctcagccaatagcagtctccactcacagaccgctggtgtggttaggagcatgtacttttaatcaaattttttttattggaatcccggtgctacatgctaggtgtgtgattttggacaggctccttaactgtgttagctttggttaatgaaactgtaaaatgagattaataataattcttggttcttaaaatcatggataggattacatgagataatgcatgtaagtgcttagcaccattttgcatttctttagcttttatcgtttttatgttatatttgattttacatctttggcactgggaagaatgcctggcatatagagtgtactttgtgactataatttgaccacacacagttaagatattcatttatataatagatatgtacgaggtatctattatgtgtacgaggtatctattatgtcagtaaactatacctctcgggaaaaatccagctctcctcttgtttttgtaaatacagttatagtggaacacagccacaccccttcatttgcatatcgattatggctgtgtttgtgctacaacgacacagatgattagtgacagaaactatatgggtggcaaagcctgaaatatttaatgtttgcccctttactggaaaaggtttccgatccttgttctaggtattgagaatgaaacaatgaacacaataaggtgatattcctacttttattatagtcaaggtaagacagacacgacacatataaataaatatgtacttacctatacacatatgcacaaaacatctgtggtaataaatgtaaagaaaaaaatacagaaatgtaagacagagagaaagcaggaatggggggagaggaaaattttttagatatttcccatttaaatgcctctaatctcagaatagaattttatagtatcgctttagtaattcatttacaaggtagttttcaatagaaaaataaaaactcactaccccatgaagtctcattgagcacaaaattcaggaaccaccccaggttgcaaataaattcagacattgcctgtcataaaaagctggttcggagacaactccatttagtattgtagaactgtgcaaagaacacgacactttgctgactggcatgcatttttgtccaggagtagttttccccacatggagaatagcgacaatacaaccgcttccaatcaaaggggaaatttgtgctccttatctagcttgattgtccatggataagaccaagttcaaaagtgtcagttctacaagcaaacaaacaaaaagccctgaaggcctcaagagctgaggatgcaaggaacaagtagagtttccaacacagaggaatgataaatgctggaggtgatgggtagtgtaaataccctgacttgatccttaaacattctatgcatgtaacaaaataccacaagcacactgtaaatgggtacagatagtatgtatcaataaaaaaaaaaaagaatacaaaaagaagtagatcagggatgctttatatggttttctaccttgtgtcttattttcaggtgtgttttcacaggcactacctttgtagaacaggttgcttgctgtgacagctcctatctgagcaaattgcattattaactagattgaaccaggaggtagggcacttccacaaaattctaggacaggggtcagcaaatctcttctgtgaggagccaggtcataaatattttagattttgcaggtcttttggtctccgctgcaactcctcaactcttctgttgtagcacaaaagcccctgtggacaatgcataaatgaatgagcatggctgtattccgataaaactttagttacaaaagcagacaggatttggcctgtgggttgtggtttaccagcttctgttctagtgtagtttttccttttgtaggtgtgctcagaagatcaactggagagcagacacaacatgctcacgctctggttcctttcttctgacctattgattcagaatctctgagagtaaaggccagccatgtacacttgtactgttgtacagatgcagaaagtcagtatgtgtcaggatatgctgctgttacaaataacccccaggatgtcagtgacagcagcagcagcaacaacaacaacaaacaaaaaacatgtttattccttgctcatgcaaagcccaccatgggcatctctagggaaactttcctccacacagtgacctagtgattcaatttgtcagaggcactatcagcctgtcgctttagtttctgcaacacacagccttcttgattgacgtcactgagaaaaaccaagaggagaaggtcttccaatggtaattaaatgactgggtcactaacaatttgggcatagctacttgcaaggacatggcaaacacaatcttcccaagttcgcaggaggagagagaaattggatatgggtaaacactaaattttttttattcgttcataaattgattcaattgatgtatcgattgactgataatcattactaaacaatgtgatgtgtgcatggcaaagaacctatctgcatggtatttatgggtatatttctgtttccatcaccagaatttaaccagttatctacataagtgaaatctgaaaggaaactactctttagacctggggtcaggcaccttttactttattatactcttctacttgatggtaaaagtcattatcagttttgttaatcacatgccggacctcagatgtattgctgtcctaaaaagtcaagcacattatactgaccaaatgtgctttgatcacaggtgagacatcgggtttcacacctgttattctgcaagttatgtataaggaacatacttcatacttctttacttcctgtactgatccagtttggttggttttactgatttggttaacaagatcgtaaataatagtgaagtctctctctgtttatggttaacactgctggcccattataattttcggtggcagtgcatatggcgggtgataaactaataaagctgcagtaggaagaatagttctgcttttatttttatggctatttctttaatctgatgcataattaatgtacaaagttcaacttcgttttggtcagatcccagattactcgaggcatccggaggggttaatattttttggtgcatttgggggtaggaggttgggataaaacaacaaatttttatctatatggaaggatgcttaaccgggattttttttttttttccaaaaagaaaatacttaagttatccttgctttcagagttcatgtccattggaagtgtcaagagattctgtgttcaaacattctcaaagcaccgctttccccttaccccttacctaagagaacataattctaaaaatccctttggggaataattttctctgccttccatctctctcaatgatgtgtccaatctccacaatttgtctggcctcctcttgaactgatttacggttcaccaaaatctgtgagaggatttgccaggctgcagaccaattaattatgtttgctgttagacctgttaggtgttggcatttccattttgtcagacattttaaatttaacgtggacacatggtttccttttttttttatatattaaattaggaagctgaccacatagggggagattccaacagcaacacaatgaatttatttgagatgcattgtccttcatttgtatatagaactctttaaaaagaaattcaccatcttcccagatttttttttctttttgtttgagatggagtcttgctctgtcactcagtctggaatgcagtggcatgatctcggctcactgcaacctactcctcccaggttcaagcgattctcctgcctcagcctcctgaatagctgggataacagacatctgccaccacgtccagctaatttttgtatttttttttttttagtagagatggggtttcgccatgtttgccaggcagatctagaactcctgacctcaagtgatctgcccgccttagacccccaaagtgctggaaatataggcttgagccactgagtccagaccttcctagatattttgaacagagcctgcttttctcagagaaaatatttcttcttttgtccacagcagccctgatatccatggtgaatagtgtgttagccattttctgccttgcagaactattattataatataataatatccaaagaacagtagcaatttttatatagcatttactgtatttcagataatttttaaatgcgttttacatatattaactctttatgtccttatgtaatgctctagggagggtgctataattattcccatttttcagatagaaaactgaggctaagagaagttcagttacagataccacacacaagaaagggacagcatctctggaagtctgactcctaatcatgggtcactcttgtcatcagatgccgggcaaggtgaagccctacattctacagacgtgttttcagaaagtctacaccacgtttatgcactagtattcatttatctggtagggtcctttgattttattgggtagtgctttatgggctgataaatgaggtgacattaaggatagtaacactgttttcttcccttttctgtaaaaggtgagatggttgcctatggtgttagaaaggattgcaaaagatttacttggggaaaattagcttcctctgcactcccctgctccatttctactgtaagttattatgatgaaaaaaaaaaaaaaacctgccagaacattggcttcaaggtgaaaatatttaggcaaaatattaccacagggaaagtttattttaagcatcaaggttaaaaagacacatgtgtcagatttaggattttatgcttaaagctcatgacattgccacaaagtatttggttggcaaacttttcctgcagagggtcagataataaatattgtagggtggtggaccatacggtctgtgtcacaactactcagctttgcagttgtagagaaaaagcagtcataggcaatgcaaaagcaatggaatgttgcggcattgcagtaaatgtttttaaccacagtcagcgaggctgatttggtccacaggccatggcttactgaccccctgctatcaaggaatgaccagggatttggagataggctttcaatccttccttgtcatgtgccaggtggacggccttgtggttcaaagacttctttgaaccttgcgtagtcacaatctctctagatgttaaatagggaaactgctatgccccgatgagcatggtcatgagaactgaaggagtaccagaactgaatgaatgaagtactggattcagtaaaagaaattccatgtcatccttctctgccctctccaaacccctttggttctacttttccctaccttgtaatatttttgttaacaagtggtaagagttaattaggggtccctgagatttttagggtgcttttacattttggtaaggctagtagtagaaaagtactacctaaaagagaattaactaaattccttccttccttcttccctccctccctcttccctcccttgctctctctctctttctctcatctctctttctctcttcctctctttctcgcttgcttgcttgctctgttgcccaggctggagtgcagtggtgcgatcttggctcactgcaacctctgcctcccaggtccaagcgattcgtgtgcctcagcctcccgagtagctgggactacaggtatgcacgatgcctggctaggtttttgtatttttggtagagacacagtcttgccatgttacccaggctggtctcagactcctgagctcaagcgatctgcccatctcagcctcccaaagtgctaggattaaaggtgtgagacaccatacccgggccccagaggagagctttctgagtcaccatatgtgaagtggttcttacgtaatttctacggaaaaaaaactcagccgtcgaaatacaggaaggaaaagggttaatttctttgtaacagagatagtgaataacaagcataccactgattccaccaatctaatatacatgacacaaatcactgaaagataataatcttcactgataaactgaatgagtcttcagaagcttgttcatgacagttctttagtcattgtcagtgattcgtagttgtctcataaaatgaaacctattaggtatctttgacctagttaccttttagggtcagagactttggagattttttcagattataagctacatgaagttgttacagggttgctagtttaccttcgctttgtaaacagtgatgctcctctatagggatgtgaggttgaattccgagagtcacctgcccccctgcaaaaaaaaagaccaaaaagtaaaaagcatcttccattcttcctgaagccccctctcttcatgaaatgtcctcacattgaagcctgatgaattcgttcatgttcttggctcgaaagttcttagcagcagcagcagctgaatttctgttgtctgttcttgttttccttgtttttaccattttctagatattttatggtgaactgttgttatagaaatatggaaacaagggatagtcctaatacatcctgttgcaaagaacagaaacccagtttagactcagttaagcaaaaagggaaaatttagctttaaaatattccatagattccagaggattccagaggaggaagagcggcaggaagtacgatgaagcaaagaccaggaaagggatcagcaccctggacagcatctctttcatttctctttggaaatggagcccatcagatttgcctcacccctgacttagcactttgtactaaatcccttagaaatgccttcccttaatctccacattcctgagttttttatggcaattgcattttagctcaacttctatgtcttccaaagatcttccctgttcacaacaattacatgccctggtcataaattatcttattttctttgttgcttgtttatcatatgcaccttcccacactggaatctaagcttcctgagagctaagccttatttagaacaatgcctgacacataatgggcacacaacaatatttttgcttaaacacatgtataagtaagcgaatgatcccctaactgccaatttcctaggagagagaattgaattgccccagctgggatcagtattcaaccctctttttattagttgaggcagagtgggttgagtcagatagaacagccacttctcctggctgcctgtgtctgaagggaggtgtacttgatttggggagaaaaagaagccatggtgaatcacgaaaacatattccccaatgacaagtgtatcgtgcttgtcaatttacagagggtagtgagggtaggggttgatctcaaatttgacagaagaaacagaggtaatttttttctacctgaaaatctttaccagcacttgaggccagtgggcaccatgaaagtatcctgaacgaaagtgttttatttctctattgttattaaatagtgaaaccttcgttgggttcatccaaattttagctataagagatgctttatctattttttctttactttgtcaatagttctgaataaatgtgtgtgcttaagtgtgcttgcacatgtgtgtattttttttccaggctttcagaagcctgcattaataatctcttagggtcccgaagcaggaacatgtatgagaatacagaaccagatgatatcttcaggcagaaatttaggaagagttgactcacactgaacacaagctagttcttaggcttactgtcagaacaaaattgataaagcttaggaggacatttcatctcctttcagtgtggttcagcaaggagctatttaatgcctcctattgtcaggtgtggttttaggtaccattcgtatcaggtctctgccctcatggaaccaccattctaattgagggagtagtttaaaggggatagatgggaattaataaaccaataaagagaggctaaaatttcagactgcaatgatgacgtcattaaagaactgaaataggatgatgtgaactgaaatgatgaggggcgatgcagatggctggaggtggcctaaagcccaggaaagtggtggtggagaagaaggcaggattggtgagaagagcctggcagcacaaagatgtgtgtaaaatcactgacaggaaagggctttgtgtatttgaagatcataaaaagagtagcacagggctggaattagctccgtgaacaagtggagagaaggaagtggagaggcagatcaaggaggacttctttgcttatagcaagggggttgaattttagttttaggacaataggaagctgtggaatgaccttagagggaagacatcatccaaatgacagtgtactctgttccttagctgaagagagaaaaaaacagatgcaagtgcaagaggttttagtagaagtctaggggatacatgatggtggttatagcatatccacaaacacctcatgacccagggtgtctgttcatctgcattgcatgcatgtttttacctcctctgacatagttatttgcagccctgtctcatggtcaaaagttagccaagtgattgaagtatgacatattggctgtgcctttgtgacaatccttagtcttgtctgtttagcaaacagtatggcaagttggaattctagagcagtcacagtataccatgcttgatcacatgggtatacctaaacagttacaaacccccaaacctgattatgagctcttgtgaaacttctctaaaaatttggggcaatgtggagttacaggtagaacttgagcttttcaagtcagaaaccttagttctgaatgtttgtgcctctatgtatcaactcagaactttagaggagatccttgccctttaggtgtgtttgtgtgttgaagtgttactaacactattaataatgtttacacatgggtaatattaaccataataatgcttacttggtgcccaaagtacgtttgatactttacatatgttacctctctcaagcattacagtaaacatacaatatgcataggatagccccactttgccaataaggaaattgatccttagattaaataacatacttgaaattgtgcagtaagtacatggaggaatgtccatacaatatatctatttaaaccacctaacagtggggtattatggaagagcatatgggagcactttgcaaagtgtcaaccgcagaataagtgcttgataaatttcacattatacctctctctctctctctgcagatttcagtcacttatgaccacagaattaattctaaagaaagcaaattgaaggaggtgtttgcacgtatttttttttccctaatgattctactgtaccctggagcattttcacggtttgtgtttaatcacagaatctcagccatgatgtttctgacaggcaatttccttaatgcatttgacagagatggattacatggagggccattggacgccatggttttgtctgcaaatggtaagactagattagagctatctgggtctagtgcctccagtgatattgcatcctaataattcttatgataacatggatcacctttgtggacacacacattcttggccagatgggatacagtggttttcaagaaaccctgccacttttattacactttgagaaacatctggactaatatttgtgtgtcagaatcataaatcaatttagtttgcggagataggcctagttatgcggtttatcttcaaaggcactcttttttgctaccactgaaagtggtaaatgaggcacataaatgtcgagatattgaattccttctgaaactgtaaagtctttacactggcatatgaagatctgagcatcagtcagactctcaggtacttgatgaacaagagtgatttggattccatggcattttatccctagataacaacaaacccaacccattcttgagcaatgatacaattcccactggtgactcacttcctgaccctttctccccgtcctctgaagtatgtctcagccattagttcctatgtttattggcgcactttagtatagatcaaaggcacacagacaggttcagcgatatttgctaaccctgggaaacatgaatgctactattttgaaggatattctttatttgtcactggtatttaattgcacagatatgtacaaccattgtaaaggagattcctagatatcatgatacttatctctaatgacataaatatgtatataaatatacataaatataaatgtgtatataaatatttatataaacataaacatatttatataaacataaacatatttatataaacataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataagcataaacatatttatataaatataagcataaacatatttatataaatataagcataaacatatttatataaatataagcttaaacatatttatataaatataagcttaaacatatttatataaatataagcataaacatatttatataaatataatatttatatacacatttatatttatgtatatttatatacatacttacgtctttaaatataagtttcatggtatctaggaatctttgtgtccttagagattctatatgaagcaatgacattattataactaacagcattaacttaaatctatcctgccatcaagtatccagtctgtattaaaatgtattcagtgttttgaacaatattctttatgacttatttttaaaatatagctctctaggccaggcacagtggctcacacttgtaatttcagcactttgggaaactgaggcaggcaaattgcttgagactgggagtttgagaccagcctgggcaacatgaggaaaccccacctccacaaaaaaaaaaaaaaaaaaaaaaaattcagaaattagctggacatggtgatgtggtcccagctacttgggaggttgaggtaggaggaccactttagcctcatgaggtcagggctgcagtgagccatgatggtgccactgcactccagcttgggcgatggagtgatactctgtctcaaaaaataaataaaaaaataaataaaatgtagctctctagtcattttgaagtactgaaatcatatgtaagaagagtaggaacaagtagcataacacaggatataaataattaaagtaattttttcttaaagtgcatctgtccttccttaatccttctgagagattatcgatcacttaaaaaattgtgtgaagtcttacaaagaagtatatacataatatgatactataagaaagcccttggccaggcacggtggctcacgcctgtaatcccagcactttgagaggccaaggcgggctaatcacgagatcaggagatcgagaccatcctggctaacacagtgaaaccccatctctactaaaaatacaaaaaattagccaggcgtggtggcgggcgcctgtagtcccacctactcgggaggttgaggcaggagaatggtgtgaacccgggaggcagagcttgcagtgagccgagatcgtgccactgcagtccagcctgggcaacagaatgagactctgtctcacaaaaaaaaaaaaaaaaaaaaaaaaaaaaaaaaaaaggaaaagaaaagaagcgcttttaaaatcttagaaacaaaaatcgctctctgtaaaataatattcatcagcatttttcttaatggtgagaaattagaaacaacctaaatttctgacatagaaaattgcctaatttatggcggtcatattggaaaatgttcaccatgtattgtcaagtgaacaaagtggtttccatgaccgcatgggtcaaatcacagcactttaagaatcaactcacagagagaacaaatctcgagaatgtatctgactgtgtgctagccatagttatctctagatagtgagattataggccatttttatttcattttaacttttctctgtttctcacattttttgcatgcaatgtggaatatttggtaattgtgtttaacaattttggaagatcagccaactcagcaagaggtgtattatctaactggaaagaaaaccagaggtataaatacgatggaatgaaacactccctgagcctgtgtgcattctgcataggcttcttgaaatagtccatggctgcagagatggaaaagttaacataagtgctttaagttaaaatgaagaaactgttgtacatcttcctatatttcctttggctatctaagtcctgcattagaatgttctgatattttctgaatggggttttatgaaaaacctagagttaaaatttgcattgcagttagtttcaaaatgctatttagaggaagcttttagctgcatgttacagaggtctaatatggaccctaactgaagttatgcagaaaggaaatgttttgctgtgtgtgtgggtgtctgcaccttttctccccatcacccacctcgttccctgaatgctattttatactctaagcaattaagagtggtttatgctgcagacttttccaataagcattgactcattataccagtccagtatcattatcctgagttgaacatgtcctgcagcaggtttcatttattctgctgcagtcttcatttctaccatatatttggagattcagatacagatttgccttgtaattgtcaaaagtaagaccgcaagagctggtatagggcatgctacgaaggaaccaaagaatgacattgagttggctgttaaaaatgcaaattttggagttggaaaggacatcaagaaaaaggtttaaggaacagaggatacagacagctaaggattggggaaagttctttgacaccatgaagactataattgcagcctgggtagcttgataaaccactcaaggaagggttggttcaagaacatcaggctagaggcaagtcaagaccttaaggcatttggaggtgatacggagtgatttctcgaaaaggaattctcaatggatagaatcctcataggaagacctacactgattcaggtaataaggagtgatttctagaaaggaatcctcagggctgggcacggtggctcatgcctgtaatcccagcactttgggaggccgacgtaggtagatcatgaggtcaggcgatcgagaccatcctggctaacacagtgaaaccccatctctactaaaaatacaaaaaaattagccgggcgtggtggcgggcgcctgaagtcacagctactcaggaggctgaggcaggagaatggtgtgaacccgggaggtggagcttgcagtgagctgagatcgcgccactgcactccagcctgggcgacagagcgagactccctctcaaaaaaaaaaaaaaaaaaaaaaaggaatcctcaatggatagaatcctcatagggagacccacactgattcaggtattctctccagtttagaatacattgcccccactccaaaacactatgtcccccaaaacacacacacacacacacacacacacacacacatacacacacaaaatagagcacataagccactctatgcagcataattatctgtatctcattttcccttcatttgtaaactagcctaccactgggaaaaaggtaccataggttataaattactgatggggtctaggtcagcagttcccgtggttcccacagacacctgcaggcaatcccttctataactttccctatgcatccagcaagtaagttttctttctttcctccagctttctggaagaatctgttcaccattgtacatcttgatcgcctttatgtctgcaataggcccaactcacatccataagaaaaacagatcattctcctaattgaaatagaagagcttgggcaagacatcaattagtgatgcaaatgtagagttcttcattgagcaatgacaaaatcccaagacttattagaagaccaataagaaatggaaaaccatgatttactggcagggctagcacagttaaatttaaaataaaaatcttggccgggcacagtggctcactcctgtaatcccagaactttgggaggccaaggcgggcagattgttctaggtcaggagttcgagaccagccttgccaacatggtgaaaccccgtctctactaaaaatacagaaattacccaggcatggtggcacacctgtaatcccagcgactcgggaggctgaggcaggagaatcacttgaacgcaggaggcggaggttgcagtgagctgagatcacaccaccgtactccagcctgggtgacagagactccgcctcaaacataaataaaataaaaataatataaaataaaaaataaaacttccctcattgtttttgttgtcagcctttacaagcattgatgcttccaactcttccacaaattcccaacaggtatttttacatatcatccaggcattttttttttctttcctgagtgatactctgatctctatctgatgagctggagagtgacctaagttagaagggaaagtagaggaggttgctaagagggtaggtgtagtactgaggtatagagggttggtagagtggtattgctactcagaaaccagtaccacatgaaatcagaaattcagctccccagaaatcagtgccattccatcaacaaacagatccactgtgttctcctggccttgcatggttctaggtttgtagagcaagtttttaattcgggtttatggcattgctcatattcgccatttcagtcatttttggtaacagttacgttgagcttatctgcatagacgcacatgatgaacaaggattgactattcttcagaggatgttaactgtttagagaatcatgaaggaagcatattttacaaagaccttttttttttcctggacttctccctaatcatctcaatcagaaccttgaaaaaggggcccaggaatgcgaagtgtatgcctgtctcccacccccacatagtgtctagatgatcaatcctattcggggaccccttggatgtgagtgtgatatcattagaacataatgaaactgtgattcctaacccagaggaaaatccatcttaattcttcaccatcatactttatagttagtgctctcttccaaaggaaacccctttcaacccctctcattttttaatatggaactttgtcttaataatggatttcttcagtctttaatatttgatgggagaagtaattccagtcatggcacatcagaaagttgctttttttcctctttctaataagacgtataatccgttgctgacaaaaaaagaaaaaaaaaaaaacagcacattgctacaatatttcctggatgctttacaatacactgtgacaaatggcgcctcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagcgaaagctgaaataattgagtatgaagccctaagaattctctgtggtggacaactgtaagcatagccttctaaccattgaggcgaaagagtccgtttggttttattaaccatcaccaggcaactttgaggcagaatgtaagccttgggaatgaaatgcaaattctataataggaacatcattgtgataataatttattaaatttcctgagccgtctccctctaaggagggctgcacaaacggccctggtgattaatgttcaacatcgtttaacattttattagagggaaacagtttttaatctattgatgccctgtctgtagaattctacgagctgttttcaaaaccagagaaagggggataaaaaaagaagcaaaaaataattggtgggggaagggggtaggtagtagaaggaattcgcaatagcggttctagttctgatgccagatttctcagaatctcctgtgttttactggcattttattgttttagcctcttggtagcctgttgatgttttgtgcaaggagagagagtttccttgtgaatctgacgttagggaaaatgtcatattcagtggagaggttccatctaagagagttggggtgagaaattggctgaactgggtgcttctctgaatcctagtagtgtttgcttaggagctttagactcaaatgcctatagaggccagaagggtcccttcaatggagattataatacgtggaatgtagtaaagtacttagcaagcactcttcactttgaataaatattgaggtactgaagcatcaactgtgagaagaccaaagacaaataacagcaaaatactatgtgaaatcatagaggagatccagacacacgaaaagggggccaaatggaaaaactaatgcaatagacagtttagatcatagtattgtttcgacgtcaatttcctggtacccatcattgtattatgattaagtatgatgttaaacattaggagtgactgggtgagagacccaggagtgctctatattatttttgcaatctttctgtgagtctaaaagcatttcaaaataaatacaacatttttaaaaagtaaaattggaacatacaaaacacactaatacggaagatgaagtccgaggatcatgtgcttacaacattgttacttcgccagtctcacaccctcttctgagaacaatgtaaaaagcagagagaaagatctcttcccctcctctttgtgtcgacagacatctttgggttggacaaggtggtaggcaaaataatgcccttgccttacctatggccatgtcttaatctctggaacctgtgagcatgttgggttacactgcaaaggaaaattaagattacatgtagagttaggcttgctaatcggttggccttgagataggcgcattatcctggattatctggatggatccaataggattacatagggttgttataagtgaagagggaggcagaagagagagagtatcagagcagctcttcctgaaaagaactcaacacattattgctgtctgtaagatggaaggaagccatgagccaaaagcagcaggctgccgctagagtctagaaaaggcaagaactcagattcttccctagaacctccagaaaagaacatgccccacaaactccttaattgtagctggatgagacctgcatcagatttctgaactacagaactataagatgggttgtttgtgttgtttaaagccatcatgtttgaggtctttgttacagcagcagtatcaagctaatacaggcaagtaatcaatataactgcaaatgcttttatggtccttacacgtgccagatgctcttatgagcattttacatgcattaccgtccttgatccaatgaggcaggtactacattgtgtattctgctttataactgaggatactgcaacagtgtgatgttaacttgctcgctgtcacagagctggtatgtgacaaagcagatgcttagtcagaaatacagagcccatgctctgcaccagcaaccatggtagacagctcagaatattagtactagactctagcacaacaggtcctagaagatattatggtaatgtatttacgtaactcaaaatgatcagacatgtcacaagaatgaaagaatgacagactaaaatcttcttggagagttgactggaaggataagatattctagtagcagttgaaaatatagtagcatctatctctagctatcttttttttttttaaggattggctaaaaatagtctttcccaagtataagccgtatcatattattatggatttagacgggtatacatgatgctattaaataacattgaatcaattattgggagaaggagttattctctttccatttctctttccattaccctattcgtgtcaatgagaaagtctttatttggtactagagtgtcttaaacatctctctaatactttgtgatctctgtttttagtaataaaatggaagcctccggctcagtgtctacaggtaatggttgttagattttaataacttgtgattgcactgtatttattttatggctaccttttattcagaataagtgatattgttattttatcatttacattactgatatccagttgccttttaaaaataatgcatttcaatttaaacaaagcacatcaatgtaaaaagatactaagcagctgacaatttatgattatggtacaggatgaccgtctagtgactttggcagtggaacggctagagtttgggaaaatctagctctttggggctaaagatttcaaaatgtacatttaaattaccaaacagatactcattactaaaactcaatgcctgaaaccatctttgaatccattctgttttctacccctttcccagaaacacttcgttttattacatttagaaagtggtgaatttagcccaggcacagtggctcatgtctgtaatcccagcaattttagaggttgaggtgggtggattgcctgagccctggagtgcaagaccagcctggggaatatagtcaaacctcatctctacaaaaactacaaaaattagctggacgtggtggtgcatgcctgtggttctcgccactagggaggctgaggtgggaggattgcttaagcctgggaggcagaggttgctgtgagccgagattgtgccactgcactccagcttgggctacaaaatgagaccctgtttcacaaaaaaaaaaaaaaagtgaagaattcaaagacagctgaataacacctttcaatattttatcgaggttaataaaattgattggttcttaattagttgtttattgttcttctaattctagcaacaaaactttaaaaaattatactctctgaattttaataaagagctcttcagtctatcaacacccttaagtctgtcaacttcaccatgttttgtgcctcatattgcatttcttgttggaccagccatattaggagttggggtggactctgttcatggactgagtttcccagaatagccttatatttggtgataatgtctctggctgagcctcattctcttaaattaatttcatcacacaggcttgcaaaataaggcttcttgtgaaagtcttggttgcagtgtcttttctagccagtttcaccaatgacctggtgtgcaaatttgtccactgtaagagtatcaaagacatattgagaggaggtgatcattattacacgacctgggcaggtggctgtcctctaatattggcaaggcaaaacagaacaactgacccaacagcacagatttgaaagactgtttgaggacctacgatgcttgctcttgctctctttatttatgtatttatttatttgtttgtttatttattgagacagagtccaactctcttgcccaggctggagtgcagtggtgggatctcaactcactgcaacctccacctcccaggttcaagcgatagcctcagcctcccgagtagctggaactacaggcctgcaccaccacacttggctaatttttgtatttttagtagaaacgggatttcaccgtgttggccagactggtgttcaactcctgacctcaggtaatctgcctgcctctgcctcccaaagtgctggggttacaggcatgaaccactgtgcccagctcgatgctcataattttagaaaggtgcctggtttatatttcttataaatgtgtcactgaataaaggttagcccacgtgatatgattttttctttcattctctactgccacactgctatttgtggcaagatctaaggagtttcttccaggctgtcaccgtctgaaaaaaaaaatgtgagtatcatatttcccagcctcccatagggagttttaattattattattattgttattattattgtttgctcttttctcttcatcatcctactcctcctcatttttctaaaggaagtaaaggaacaggcttggcccaataattttgaagtataaataatcagtatgttccatagtcagaatggtaataatgattccgttaactcagtttatttagtgcttgtgtgcatggtgaatgtaatgttcttgttatcgactgtgttatcttcactctcccctttcatcctgaagatgtctcagggaatttctccttcaacttttcctacccaccctgcttcactccccctctccccagccccatttgccactgacttgcttagcagcacaaaatcaagaaacatctttcattcagaccattgccaacactgatagtgtaggtacccaaaggtccaatggcttcccaaacatttaagaggcgtctacaatgtgcaggttagtgcaaccggctctttaaatgcacaaacccacttcaccctgacaacaatcctgagccatgaatatttttattcgcattttttagaggaaaccagggtcaatgccttcaaagaacttgtagttaggcaaaggagacaggcatgtgtgtataactataagtaaaatgcaaaggcatctgtgtacagagggtcaggagtcatgctgcaaagtgagtttttggaaggtttgcggaaagaagggaagcctgggcaggcttttgaggatgggtgggaattttttcacacagatgatttatggaagggtgtttcaagcaaagaggacagcatgtgcaaagggaaaaggaaatggaattctgagccaaaggtaaatatgcacagctaaatataattagagtggtgtgcagaggggaagttgggttatctgaaatatataaatccagtggtctaatctttgcacgcaagtctgggtaattttaaggagagtttaaaagactccatttcgaaggtgcacaccatagccatctttcagccagttgctccttgtgtgctagacacctgaacacatgtattactcctgttccatctctcccagttattccttctctacccatctccaatctgtccttcattctagcgttctctggtttctccaggctgttgaaactaagtacagatgtggctcttccaagcctccttcatagccgttgtctttagggatgaagaaaatgaataaggaaaactgtggctctgagcagctattgcttcatgtcgtggttgaagcaggaagcgactgagcttgctatcgattttaactcctgatcttgggaatcccagagcttctttctgtttctggagtgatgtttttctttgaagctaagttaaaaggtagtcatggggagagagcctaaaaacctgtgagtggaaaaaaaaaaaaaaaaaaaaaacatcaagctgtgatactgcagaattatcacagatagtgtaaaactgtgtggccatgccttaaaaaaagttaaacataaaattaccacattaccaagcaattccacttggaagtttatttgcagtaacattgaaaacaagtactcaaacaaaaatgtgtacagaaatgttcatcacagcattatccacaatagctaaaaggtggaaacaactcaactgtccatcaccaggtgtgtggataaactaaatgtggtatatccctgtagtagaacgttattcaacagtaaaaataagtggagtactgatacatgctacaatgtagatgagagcattatgctaagggaaggaaccagacacaaaaggtcacatgttattccatttccgtgaaatatccagaataggaaaattcacagagacagaaaacagaatgggggttgccaagggagcaggaattgggagtgtaactgaaaaatgatcatgtgttttctcttttttcccccgttccactcagctcataccttgtggttttctttctttctttttttttttttttttttttttttgagacggagtcttgctctgtcgcccaggctggaatgccgtggagcgatctcggctcactgcaagctccacctcctgggttcacgccattctcctgcctcagcctcccaagtagctgggactacaggcacccgccaccacagctggctaatcttttgtatttttagtagagacggggtttcaccgtgttagccaggatgttttcaatctcctaacgtcgtgatctgcctgccttggactcccaaagtcctgggattacaggcgtaagccaccgcacatggccaatatacccggtggttttcttctggggtgatgaaaatgttttgaaactagacagagggtggtagttgtgcaacattgtgaatgtactaaatgctactcatttgtacacttaaaaatagttaattttatgttatatgaattccacctccattgcaaaagagataaaatcaaaaacaggaagacagagtgttttagtttgttttgtgtttttgtaacagaatatctaagactgggtaacttaaaagcaatcaaagtgtatttggctcatgggtttggaggctggaaagtccaagagcatgacactgcatatcacatgggctttcctgctcctccatcacatggtggaagggcaagagggaagaatagatgaactcacttttataacaatccactcacatgataactaactcactgcagcagtaatgactttattcgtgaaagtggagttctcgtaatctaatcacctcttactgggcctcacctcccaacactgttgcaatggatattaaatttctgacacatggactttgggggacacattgaaaccatagcacactatcagaggcaaaatatagtgttggttcccaggcaatgagttggctgccttgttcacagtttgctcagtatgaaccatgcttgcaggagaacccctgaaatcaacccttagagaaatggtgtccatctgggaaagtagaaaaggagacagctccaagcaccaggactgagtttcagttccaagggacaagggaagtaagaatatcatcaccacaggtccgtcctcctccccagaggaagaacacaggctgcagaggtgacagctcacaatgttagggactgttgatgagaaaattggaaatggatggatttttatggcaatgcatttttaactgcacttcagcatagagggggacattttaaggagctaagagcttaaaccagacaagatttccttcagtgtgataataaatacaccaaagtgcccttttatgtttaataattcaggatccactgagtgtttaaagggttttttttctgttttatcatttgaaaaatcgaatggtaatcatttaaaaagtagtaggtgagaaatgttttccaaataggccctgaatcatgcacttcaaaatgtctttggaaatgaatgactgagtgtttcaggcagcgtacgcctgaaggtttggaagttttaacacagccaaacacctgtcattgctgtgtatactcatgttcagaggaatggtatctacttccatacacagaatcagccaataatctgatcagggctgggatgaaattagacaaaaaggctgggcagtgcagtagctcacgcctgtaatcccagcactttggcaggctgaggcagaccaatcatttgaggtcaggagttcaagatctgcctttgccaacgtggtgaaaccccgtctttactaaaatacaaagattagctgggcatggtggcaggcacctttaatcccagtttgctcaggaggctgagacccaagaattgcttgaacccaggaggtggaggttgtagtgagctcagatctcataactatactccagcctgggcaacagagcaagactctatctcaaaaaaacaaaacaaaacaacaacaacaacaacaacaaagaaattagacaaaagaacaaacaacgtgttggggaacacttttgtaatctcattcttgaatgtgctcagaatgtggatagtcacaatcatagagccagatttctgggaaattctagagtgaaatctaaaagtcagatactagtcataatacataatagtgtcagggacatgaacacatagcaccaacaaaactggtttgaattgttctgggctacaaattgggcctccacctggaatataatgcaaaatcctaggaagtagtgacttttagaaaggaaactcgactgtccttgtagatggtaaggatgatactgtggttctgagatttaaagcaggtaggttttcccagggagtggagtggagaagtgaataacttaatggtgacactaagttggcctgtcttatggaagagcctgaatgtgacaggaagcacgcatgtgcatcgttaagtatcatcttagaaaatataacccacaactgtgctctctccatattcagcaaatgtttattgcacctctatttatggtgtgcctgtcagacactgcagtaggcactaaggatgatgttgcaatataccccacagacaacatcactgcttgcatggagctcatattttctgctcgaggaaaaacattcaagaaggagttgtgacagaaactgccagctgtctacccagtatccctttatgccttcttttaaaggaatagagtgcttggaaatagttcacttagtcagagtcagtatgccccaaattaaaggataataatgctgtgttcctcggcttagcagagagggatccccattaagatggcagtgaaaattattagacatgcatcctgggaaaagcctctaatagggactaactcatcgtgatgaaaacaccataggccctttcatgctttctccgcgctgttgtatgacattatgtgactttgaggcaacttcgttggtggaatctatgttctaaggataatggaataaaaaagtgaatgaggcaagaaggtttaagatggaatatgtagccctgaacttcttgtatgggagagaaaaattaatctatattttgtttaagccaccattatttggggactctctaaatagcaaccaaattgaattttatgagatcagtgtgggaatcacaaatataaatttatttctgaatgtaaaaattgctctgcaggcaacaaagctggaagatatgagagagaggaattggggcaagggttggagagaaagacctctctgaggttaaaacaaagtctggtatatgcacctctcagggagaaacatcccaaaccaaaggaatgccagataccaaagtgagcaacacagcatagcagagaaacaacggagagccaggtagtagaagaggtgaagtcaccagctgaggtgaaggaaacaggagagatcaagtcctgtgtctcctattgtgggctatgttaagaagtggggattctattctggctgaggcaggaggtccttagtttgatctaggcaagagaatgccacgatctgattcttttttttttttttcttttcttttttttgagacagttttgctcttgtcgcccaggctggagtgcaatggcacaatctgggctcactgcaacctctgccccactgggttcaaacgattttcctgcctcagcctcccaagtggctgggattacaggtgtccaacaccacgcctggctaatttttagtatttttagcagagatatggtttcaccttgttggctaggctggtcttgaatccagacctcaggtggtccacccacctcagcctcccaaagtactgggactacaggcaagagccaccatgcccggccgatctgattcttatttacaaagcttacccaggctggtagagaatgggcacggcaagcgtgaagttaggaagctcatttgggcagtgactgtagactgtagatcagagggagtattgatggtggggtagacttagatggcagaggagatgtacgagggatttatttcagaggtaacactggcagaacttgcagaagtttgggaagccaattaacacctaagtagcatgtgttaggaggatatgcataaatgtagaatttgcattgactttggaagatcctcccatggtctttctcctagagccgcttaactgtctccaaaaatcaatatgggttactcaacaacaacaacaaccacagcaatataaacaacttgattaaaatggttaaaggacttgaatagacatttcttcaaagaacataaacaaatggccaataagcacatgaaaaaagatgctcaacatcattaatcattagagaaaagacaaataaaaattacaatgagataccacctcacacacattaggatggctgcaaataaaaaaaaaaaaaaaagaagcacagaaaacacgtgttgataaggatgtggaaaaattggacccattacgccctgtgggtaggaaggtaaaatagtacaggtgctgtggaagacagcatggagattcccaaataattaaaaatagaactgccagatgatccaacaattcttattctggatatatatttaaaagaggtgaatgtagagcaggggtccccagtccctgggtcatgtagtggtaccggtgtatggcctgttaggaattgggctgcagtggatgagcaagcaaagcttcttctgtatttacagccactcctcattgcttgcatcagcacctgagctcgacctcctgtcagagcagccacggcattaggttctcacagcagcacaaactcttttgtgaactctgcatgtgagggatctaggttgtgcacttcttatgagaatctaatgcctgatgatctgaagtgggacagtttcatcctgaaaccatcccctgcaacagccccccaccctggccattagtttatcttccacaaaactggtccctggtgccaaaaaggttggggtctgctgaagtacagcctcaaagaaatgttctttttttttgagaccgagtctcactgtcaccctggctggagtgccaggctaattttgtttttatatttttagtagagatgggatttcaccgtgtgagccaggatggtctggatctcctgacctcgtgatccgcctgcctcggcctcccaaagtgctgggattacaggcgtgagccactgcacccagccaaagaaatgtttttacactcatattcataacagctaaaatatgggactaatacaagtgtttatcaatgatgaacagataagcaaaatgtgatactcacacacgcacaatggaatattattcaaccttagaagggaagaaaattctgacgcatgcttcacaaatgagccctgaggacattattctaagtaaaataagccagtcacaaaaacacacgcactgtataattccactcacatgaagtttgtagtgaaaagcagagagtcaaggagaatggtggtggctggtggagaggaaggtaggggaaaggacagttattgtttaatgggtacacagtttcagtattacaagacaaaaagagttctggaggttatggtggtgatggttgcataacaatataaatatacttaatgctactgaattgtatgcttaaaatggttaagatagtaacttttatgttgtatttgtgttaccactgtgaggaattggaaaattatagaggtgggccgtgcccaggattgcagtgagttttcagctggcacagctttgtccatgcttctcacagctcagatagggtccctctatgtgtgagccctagtccacattttggttaatacatggtctcttccatttctctgtttccctttgcaaatatctgcttggttagtgactctttctcgaaatctcctcataacccaccaagcaaaggcaatcttgtgccttcccagcaagtgattgtcttaccggccacggatttaaccagaaatctaagtttgtccagagagccagtcctcagaaggggctgaagtcagaactagtcaagaaggacaggtgcacatttacatatgatttgcatctgctttacatagggctgtacaagctgtgctgtgttctcaaacatcacttacgttatattttaagactgtcgcaatctttaactaacatttcgatctgcagccagggtgcccctgacttctccagatttccatatttaaactggctacaactctaatccatgggaggtgggaaatccacggcacccacagggtatctgcagatacctgccagaaggctttactttctcagagtaaccattcattccaatgatccattctcaatgaaccatctcatcctacctctcatctcttgcctctatctcaggcccaccctaaacttgcagcatcactcaaggccattgtgtgtatcccattttaatctgagggaggacaggattgcaaacactttaatattagcattcccatatttataagttcctggtcaggtgtaatggcatatacctgaaatcccagtactttgagaggctgaagtgggaggatcacttgagcccaggagtttgagaccagcctaagcaacatagtaagacattgtctctataaaaattataatagtaaattagccaggcatggtgatatgcacctgtagtcccagttacgcaggaagctgaggatggagaatcacttgagcctgggaggtcaaggctgtagtgagctatgatcgtgccattggacttcagcctgggcaacagaacaagactgtgtcttaagaaaataaaaatgaaaaagttcctcactgttctaagacatcagggattattcactggcatttttccttgtatttttagagcgaggcttccttcatctccttttctccccctctccccaatcctttctcttttccttcttttctcccttaatgcaaactgattggtaactcctcattttcccctccgcacagtttctggcattcgccattctactccttggttttctgttcttgactgttttggatatattcatctttctatgtctcttgcactgtctgggactatgcacttcaacttgaaattccttgtcttttttgtcccaaagaatattgtgactttctctttatcctacactctcttttccatgtgtaacaaggggaggtgggagtatgatgccactcctctatgagatagaggtagaagttacatgtggaatatttacttccccttttatctgattttctcctcccacctcccttcactgatagtaagatagaggctgagagaccaagaaaaatagtgagagagatgaggcttgctcgatgaatattttggaaaactccagttgagtgaaaatgtatggaaatgggcggggcgtggcggctcacacctgtaatcccagtgcttagggaggctgaggcaggcagatcacttgatgtcaggagttcaagaccagtctggccaacatggtgaaacctcatttctactaaaaatacaaaaattagctgggtgtggtggtgctctcctgtaatcccagctactcgggaggctaaggcaggagaatggcttgaacccaggaggtggaggttgaagtgagatcatgccattgcactccagcctgggtgatagagtgagactctgtctcaggaaaaaaaaaaaaagaaaaagaaaaaaaagaaaacttacggaaataaacatgaacctttcagtagaatgttcctatccaccctgttttcacttctacaatctgtgtttacaaaatacgatacattttagaaaccaaaattccatgccttcttggtcattaataacattgacgtaaacttggtccaccatctgcagtctttggtgatgggcagaaagaaaacgaagtccctgagtctttgaaaagggcaaaagtgagtgcagggactgcagtgattatctgtatgaggtgaattgaaaccttaccactgagagaactgtgtgtagtaattactgaggagccaattgtgctctgcttaacgcatccaaagcaaggcagctattagtggtgtccccacttcggtgtttatgctagaatacaggaggacagcctggttttctcatacgatttgatctacgacatgatgagcctatggccgatgttgtgttctgaacacaggtgtggcttgcccacccagaggcgagtaggatgtttagttttacttagactgacactaggaactcagtaaaatgttaagcaggtttagggaagtgcttacctgatagtctaatttagaaacataatcttgtacacacagtaatatttattattggagtaagtcagtagaaacagactcataacctttctagggagacccagtaggtaaagtggatttaccagacagtaacatcttagtcttttgtgtttgtatggcaagtatctaagttaataatgggaagtaggtgaaagttttcaggttgtgtaccatgcaattggtttgactttgccttgccaagtaagcctaacataccccttataaatacactacatgcatttttagcaattagaatatttacttactgaaatatatatatacatatatgtattatatttccttattaatatatataatatgcgtgtgtgcatatatatatgcacacacacacacatatattttagaaagacacttgcaagctctcaaaaatgagttgctgcaataccattccctctgccaatcatatgggttaaggctgattttattgccagtcatatcgtactcaagttgaagtgctaagaatgctgtcttatccctcagctagattagttttaaaaggtgatcctgaagtcctgacaagcacagagtgaggatttacgaagtgacaaacagatgccgacgacatttactgtgagatttctcatagctgaattcccagtcctggccaaggagaaatatgcaacaggggagagtgaaaggggcattttaagttgggatttataaacaatcaattctcttcttatcagaaaaaaaaaatggagaggctggagaaaccgtcttaacttgaaacagtagtttattgcttcttacagcatggtctgtttctgttctgtgtggtagtcccacttacagtgcacagagcttcatggccttttgcagccaatttagccccttgcagctcagtgcaatgccatgcttcatcctggcaacttcaagggctttatggaaataccctacagatgtgtaggtgcttttgtacagttggtaactgaggcttcaaatcaccccatccatcttcatggcatttcttagctgatcagcaagaggtgtacgctgtattttcttttatagcatcttcattacctttgtgtcttccgtagctgctcatttttatgtatatggcatcattggccgggcgttatgggggttcctctggtcacgttccggcccttcattctgctagcttcaggttggtgagtcatgcatgtttctgaccagatggaacatgatttttcttatttctccactgtcccttccaagaatctttatttctctctccgttaggttcacatgaatggtagagagaggaactcaacagcacaaaatagtcaaaacataacattttattaaaaccacatccagtgcaacccccggactggcccctagcacagtgcctgctacataatagatgatccagtgaatattgacagaatgaagacgtgattggattaacgactgatcttgccacaaaaaataatgacatggaaactatgacagcaaaacagtgctccttgctgagaacagtctctgcaacctaaagaaggatggagcggaagaaatgttttatctttgtttaaaagaatgcaacaactgtggagctacctagggttctctgtaaggcagttgcctccaacacagccagggttaatttgcctgttgcacccagttcatgtagcttctcctagaatgtgcagcaatagaacgagcaggccaccatctatcaccagagaatatcttacctttattcaggagagagagctaaggagaagataaatggtgacagtgagagttgaactccacagggtgcatcctctccttcctctcaatcttagtcctggggaagcttctcagttacctttattgtgagcctcctgtaagtggggtttcttttttccatcactcactgaaaccggcgcatggtatcttctctggaaaactaggactttaggcaacatcaatcctgcaacagggaagcaagagcaactttggtggttacaggaaaagctggagatggctgtttatgtatccctggagtttggtttttggaggcaggtatcttacttgggctgaggtatgaaactgtagccaattatgtcaccatctataatcggccagattgtccctccaccaattcatatgttgaaatcctggctccctttgcctcacaatgtgactgtatttggagacagtttgtcttagttcacttgtgtttcagtaagggagtagctaacgctggggaatttataaagaaaagaggggtgttttggcttatggttctgcaggctgtgtaagaagcaggcaccagcatctgcttccggtgaggacttcatgctgcttccactcgtggcagaaagagaaagggagctggtatgtgcagagatacatagtgggaggggaagcaagagatagtggggaggagccaggctctttttcacaacctgttctctgctgggtgcagtggctcatacctgtaaccccagcaatttgggaggctgtggtgggaagtttgcttcagggtaagagtttcagagcaacctgggcaacatagcaagaccgtatctcaacaaaaaattaaaaagattagctgggcatgatggcatatacctgtagtcccaactaatagagaggctgaagcaagaagattatttgagtccaggtatttgaggctacagtgagctgtgattgcagcacttgcaatccagcctgggtgaagagtgagattctgtgtctgtaagcaaacagataaacagacaaaaagcccaccagttctcctaaggactaagagagcaagaattcactcaccctctattcccttcctggcgggcattaatctattcatgagggacccatctactcttcacttcatcttccctctatgcatgtctgtgtccaaaatttccttttcagctgggcacagtggcttatgcccataatcccagcactttgggaggccgaggtggtcagatcacctgaggtcaggagttcaagagcagcctggccaacgtggtgaaactctgtctctaccaaaaatacaaaataataataataataataataataataataataataataataattgcagggtgtggcagtgcatgcatgtaatgccagctacttgggagactgaggcaggagaatcacttgaacccaagaggcagaggttgcagtgagctgatatcgtgccattgcattccagcgtaggcgacaagagcgaaactctgtttcaaataaataaataaataacaagatctccttttcttataaggacaccagttagattagattagagcccaccctagtgacctcattttaacttacttacctttttaaaagcccctgctatcatttggataataacctcaaggcctttgcacttgcagttggctcctgccagcttattacatggctggctcttgcccttccttctgctctcagtgcaaacattacctcctcaaagaggccaaccctcaccttctcatcaaaaatggctcctcttacccattgtaaccactctattaaatttttcctttttgagcacttaagtcgcatttaaaaaaatttttaatccgtatttggtttgctggttccctatatgcctcccttcactgagtgtaacctttgtgggggcaggagtcttgtctgagtcatcattgcccaggggcgttctgttgtgttcagccaaatgttgaatgaatggatgatgcaatagatgaatgagacaagagtctctccagggaagctgaagtggcacacacactctcaaggtcttgaaaatgcctgacccctagtgcaggggttccatgatgcaccatagagttgatggtaggcaggcaaaatgaaagcttttaagccccattgattcacctgtgcttattaaactgccttgcctctaaaaatgatcattctccagtgaaaaccagggatagcgacgctcagtgcagatttcccaaaggaagaaaatccaatgaagtgcatctttgcagtgtgtgcattgcttgtcaacctgccctgcaattgtgtgtattcaataagggtgataatgatgatgacaatgattttatcagtcaagatcccacacaagaaacacaaccaataggatacttctataggttaagagatttattgcaagggagtacttataggattgcgaggctgactaagcaattcagaaatccatgggccaggccatcaggaagagtatgttggcaactcttgggcaggagctgacagcgtggaccacactgtggtcctcaaggatcacatggaccacggtgtggtccttcctcacagttttgctcttaaggcctttttccaattgcactacactcaccaagatttcttaagacaatctactttacttaaagacaatcaatgttaggtgttattcatatctataaaatgccttcacagcaatacctaaattaacattttatggaataaacggatactgtattctaaccaggttgacacttaagactgaccgtcatactgatgctaatgttgatgatgatgacaactgctactctgtattttgctcttagtaggtgtcaggcatgctgttaaagttcttacatgtgttttctaatttacaacattgttgctccaattatcattctcatagtatcaataagggggttcagggaggttaaatgacatgtccaaggtcacacagggctgaaaagtacatctgtgtgtgagcaagtctagagatccaatgtacagtatgatgactctaagaaataataatgtattgaatactggtaatttgccaaaagggtagattctaggtactctcactataaaagaaaaaaaaatttcaagaatataaaaatagaaaggagggaagaaaggaaactaattttatgagatgatgagtgtgttaaattgcttgactacataatcacttcactctgtatgtggaagtcaagataagtatgtcaaagtattatgttgtataccttagatacatacacttaaaaaaaaaaaaaaaaggactctgggccgggtgctgtggctcacacctgtaatcccagcactttgggaggccgaggtggggggatcatgaggtcaggagatcaagactgtcctggctaacacagttaaaccccgtctctactaaaaacacaaagaaattagccaggtgtggtggtgggcccctgtagtcccagcttctcgggaggctgaggcaggagaatggtgtgaacctgggaggcggagcttgcagtgagccgagattgcaccactgcgccccagcctgggcgacagagtgagactgcctctcaaaaaaaaaaaaaaaaaaaaattggactctggtttctaaatttaaacgtttatccagtgggctggtagctgtcatagggatagaaattctaggctctaggactctatcactagtaaatacagggaattaaaaactccaaggagtatttttcatgtaaagcaaacaaacaaaaaaggccttgagtcttaaaagagagagaaagagttgttgaaatctagaggcacacctagtaagcaagggtaatgtattgcatttccaggagaaaatgaacaagaatgtaagttacactgattcctgccctggggtaatgggtgggtttccttttcagctctcgtgccaggtgggcattcgcctgaactaggaggactcggggggattcaagccccctgtctctaggttgctatgagctttcacatcttcctctggtttatcccccgcccttagcacgaggtggttgcagcgtttcctaatataaatgcaagcaaaataaaattagaaatgtgctggtcgggggaagccagctacccacaggcgccgtaaattgccttttcctctcacccctactccctcctacccaccccttctcactcccatcaagccaccccaaataacctgccttgcctggctgagtcacggtttctggaaaagtggggccaagaaggttcctaacaagtcactggagtgatgattagtggatgatcagcggtcaaaagagaatcatgcatggaaggaaggtggataggattcattggcatgagtggcagatccgggaggactgcttggggcagactgtttgagtgacataggtcttttagggtcaagggagagaaaccagagaatgagggaagcacaagctactaaattttgccatcacagcagctgcctttgtgtacagtccctttgcctctgctgttccaatattgggatggttccctaccctcaggaaagtattcgcttgcctgtagccgcgttgaccctagcgcttgatgactgaggaacacttgtgttattagcaacccctctttcccactattttaaatgaataggcatacttgtatccatgcagatgctgctttagagtttagggaattacaaaatcaggtacaccctagagtggggtttctcaacagcaccagaataatgggatcagtcctgggcacgaacatttttccaagcagagtagtctcacatcccttgaaggctgagaactctcatataaaggcattccacaagttgttttagaaaaaaaacgagaaaatagcctcaatatttgaggagtgtagttattaggaataacttacgctacatgaggacaaatacctaaagcatgtgggccttaaaacctagatgacaggttgataggtgcagcaaaccaccatggcacatgtatacctatgtaacaaacctgcatgttctgcacatgtatcccagaacttagagtaaaatcaaaaaataaaaagaataacttaggctacaatgatgatgtcggtgctggtgttgatgaaggcaatagtggttacatgtaacctagtatctagctcttaccgtgccactcatattttgagaataattctatggaacacttgacttgatccttccagtcatcttgtaaggcaaatatgattgtgcctacccttgcttttatagatgagcagaagtaaatgaaagccagagattggaataggttgccaagactttactgctaataggggttgagaatggagggacataggttatccagaccctgaagcccgaactccctaaccacctcaaaacactgtcaggatcaggagaaatgcagattacacggaacaatatctggggcagaaaaacaatgaggcatcagtttttccccctttatcagtggttccccattctggctgcaacacattcgctgaggttgccttaaaaaatcacgttgcatggatccaagcccaaaccaattaaagataattttaggaatacgggactcagtgatcagtatttctttaagttcccagtgtaataggcagccagagttgagaaccattgcctgacattaaagattcacaaaatgtggtccatgaatcagactttaatagatctgttccaagttttcatgaatgagtatttagtaaagatgtggtgcatggcttttcctaattctcaaagggatcctctaatgccaaaaaaaaaaacacaaacaaggtgggaaatcattcccttggagtatgatgggagcttaccgtgtgcctggaactgaagtggatcttgagatgagctatctcatttaataatcctaacagccctgatattgtcccattttatactcaagggaccgaggttccagaaggctagggaatatgcttgatatgtcatcatgaataacggatagagccataaaccaactcaaatctacttaatgtcaaagccagttattcttaatagacttctctgatggatgagggttgaaaaagtcctgcccagcaatagggggaacgactcaaagacagctagagggctttgccagccagagggcatgcaggaactctgaagtggtgggttgttaagaactaaaatattccatttgcaccgcagagctcagaattaatttccactgtcctgatggagcaggtgggaaggaatttgacctctcccctttgcctagaaactggtcctttctggaagcttctgagcttgctatggaaaaaaaaaaaatttttccacttctttcccctgctaccttattttcttgttctctgaccatttatctcaaacaaggaattattatctttctaatgaagccacagtagacccttcatttatcctaggatatgtcacccctacaattttctgtgaagtgtttttttctcaaaagacttctgaaattgaatttcttacgcatatgggaggagaatgatctttatgatgacacgatgatcttatccagcaaatatatttccctgtagatccctactttagcagatggcatgatcggggtgctcaagctaaacacttctttgtcctccttaattcctctctcatgggcagactgctcccttcctattctaaatcaccgtgtcttgccatgcctctccgatccatccactgcctccatctccatcatctctctggtccaaacctcatccgtctctcagacaggaaaccgctgtggtttctgcttggtcaccccactagctgtgctcctacctcatcgtctgcagccagagtaataacttttagtacaaatctgatcatgtctgagctacttaaaactcttctgtggctgctctgagccctgcacataaaatccagaacccttcacacaggctaccgtatactgcgcgatctttctttttgctctccagcctaatttttctccatggtttccttcactgtctcaatctcacccctgcaaaatgaagtagacacatgttcctcacatttaatgtctgcatatatgagattagaaatgggatagtctgggtgtctgtctcacagtgaaagagttttgtttattctttttattttattttactttaagttctcggacacatgtactgaatgtgcaggtttgttacataggtgtccacgtgccatggtggtttgctgcacctatcaacccatcatctaggttttaagccccacatgcattagctatttgtcctaatgctctccctctccttgtctccaccccccgcggacaggccctggtgtgtgatgttcgcctccctacgtccatgtgttctcattgttcaactcccacttatgagtgagaacatgtggtgtttggttttctgttcctgtgttagtttgctgaggatgatggttcagcttcatccgtgtctccaagtgtaaattagttcaaccactgtggaagaaagtgtggcaattcctgaaggatctagaaccagaaataccatttgacccagccatcccattactgggtatatactcaaagtattataaatcattcttctataaagacacctgcacatgtatgtttattgcagcagtaattacaatagcaaagacttggaaccaacccaaatgtccatcaatgatagactggataaggaaaatgtagcacatatacaccatggaattttgtttattctttaaagagctttatgagatacgatttacacagtgcaaaattcacccattttaagtgtacagttcaatgttttgtaagtacatttactgagttgtacagccatgaccacattctaaatttacaccatctttataaccctcaaaagatcctcgggcagattagcatttcttcccccagttccccaatgctaggccaccactaatctattttctatctctaagaattggcctattctggatttttttttttttttttgagacggagtcttgctctgttgtccaggcgggagtgcagtggcgtgatctcggctcactgcaagctctgcctctcgggttcacgccattctcctgcctcagcctcccgattagctgggactacaggcgtctgccacggcacccggctaatttttgtatttttagtagacatggggtttcaccgtgttagccaggatggtctcgatttcctgaccttgtgatccgcacgcctcggcctcccaaagtgctgagattacaggcgtgagccaccgcgcccagcctggatgttttatatcactggaatcatacagtatttgttcttttgtatttgccttctttcacttagcataatgcttacggggttcatccatgttatagatgcgttgccagacaacatactgttgtgtggatataccatgttgtatttacctctttactagttggtagataattgggttgtttccacttattggctattgtgaatcatgccactatctgcatattagttaagaacatcggaaagtccaggttctctcattgaccatgagcagaaatccagctagtcttttgacttgtctaagccactgtttttttcttccgtaaaatgggaataataatggcatctaccctagaccgggcgcagtggctcatgcctgtaatcccagcactttgggaggctgagggaggaggattgcttgagaccgaaagttctagaccagtctgggagtcagagtgagaccttgtcgctaaaaatttttaaatagcgtctacttcatgggttattgtaaaacttaaatataatgataggagtaaagggtgtagcacagaattgcttgaacctgggaggtagaggttgcagtgagcccagatcgtaccgctgtactccagcctgggcaacagagtgagactccgtcaaaataaaataaaaattaaaaaacccacaaacaaaccgagacaatgagtgtagcacagcacatagaatgtaattagcactccagaagcctgagctattgttataattcctcttttcattacagaaaaattcttagggtagcagttcctggtagttactgttttttcacaaatatgtatttactttttaccaagttctagtcatttattcattcttttcaatcatcctgtgttgtaatcattactttcccattttatacccaaggaaacaaagtcagagtattcaggaatgcacccagggcacattggtaaggaaaagtacagcaggattttccttccttcctccctccctcccttccctccctccctccctccctccctccctccctccctccctccctctctctccctctcctttccctctcctcccctgtttccctttccttcccttccctttcctttcctttctttttgacagtcttgctctgtcgctcagggtggagtgcagtggcacaatctcagctcactgcaacctccgccttccggattgaagagattctcctcccacagcaggagtagctgggactacaggtgcgttccaccacagctggctaattatctttttttttcttattcttcttttttttttttttttttagtagagatggagttttgccaagttggctaggctagtgttgaactcctgaccttaggtgatgtccaccttggcctcccaaagtgctgggattacaggcatgaaccaccacgtccagccaggaaaactacagcaggatttatgagcgaaagcaaccagtgaatatttggaagctttgttcctggtgttcgggagtctgctgtcctctgacctcttgacttccaacccctcgtccatcactctttatcttatccctcaaaaaaggcatgacaaagggtcatgagaggcctggttctgagaatataatcaattacttggcttgaaaaggaaaaaaaaatgtcagtgtttatttgtttttaatcatagggggaaggatttttttggtgaagagtcaccattcaatttcttctgagaaaaagctttatttacatcagtaaagattgcaaggagacatcagaaagaacatttttatagtgaaggttttgagatcctagggagttcatctgaaagacttacagcattgtcactactcactgcatgtgtgtgggcatgtgtgtacacgcgtgtgtgcatgtgtgtgcatgcgtatgtgtgtgcatgtgtgtgtgtgagtgtaggtgtgtgcgtgcatgtgtgtgtgtgtgcacatgtgtacctgtgtctgcgtgtgtgcatgtgcatgtgtgcacgtgcatgtgtgtttgtacgtgtgtggggtgtgtgcgcgcgtgtgcgtgcatttgcatgcgtgtgcgtgtgtgtgtgtgcgtctgtgtgtgtgtgtgtgtgcccctgagtagagctccctctgcagaagtcaggctgaatcatcccaccttgctgactctttctaaccctatgatcctttgcctgagtaggtggggagtgagtttaaaccttatgtcttattttccttcattaatttggccaaatcatctgaaaatcactattctctacctctcaaagatgtagatggtggtactaatttaaaaattgctataatactctaagccatcatcagtatattgttttctggttttcaccttcttcagtatgcttcctatgagacagagttagaagtggaaagaggtgaagatagagatggtgaaagagggtgagagatttaaagccatattcgatcccagtgagagagctcatacagaagaggcatagttgagagagaaaatagcaaaacagtaactaggtgtcactcttttaccagcattcacagtaattgagctgagaaagaggtaaaaagtttttttgagtgattttgttaaccagaagacgtgatttgacttagggtttgtgggggtttgctgtgtgtgtgtgtgtgtgtgtgtgtgtgtgtgtgtgtgtgtgtgtgtgtgtgtccttttgttcctaactggctgtgagactttggtaagtcatcttaaagtgttttttttttttaaagtagttttcagcagagattgccttttattttttctcttctactgcacgatgcaatcaggaacctgtctagaagtatcagaagttgctgctacattttggtggacttgcacctgactcacccctccagcctcgatgcatcgcatgcagttagcatgttcagcacaatcttctctcttgggtttgggcaggcatatggtctgtgcctagcagagctgatattgctggttccaaaaaactgcctgttacatgctggtggtcacaagagaagaagaggtgagaagggctcggagccagacaaagcacgcctttgtaaatgaatgtggagttggccaccagcagtcttcattatccccgtcattgcaggcagctgagctggctttgtgtcagccctgctcggagtagccttgttaattcacccccatgaaaatggaagtttcatacacattgacataattaatgaagaggcaggcagcatgctctaccaattaacaccacagggaaaagtaaaatgggctttcttttggcatattgtgccaaagttaaggactgtaagacacagcaaataaatagagatgcttttaatgagctgcaagatcgagctgaataagtcagaaaggagtgttgggtaaacactgccaactctttgcaccgttaagagtaattgatgagcatagttgaaagtttggggggaaagagaaccgtcggctgctccaaccgtgttcatttataaatgcatctttccctgaaagctactgttaggtgtgtttaagggtgtaatgtgcaagaggaaacaaatatgacagacttgctattttgtagtgcccagaaaatatgaggcatagctgttgtagaaagaacaagcgtggcggatttttcacacttgatgggattgtttttgtcaaactcggagtaaaactggctcctctgccgtatagatccctgctctgagtacaccctggaaacaggaagcagggaatctttaagagtggtattggaatgactccattccttttagaaaagccagacggataatttaatttttgttctctatgtttgtgatatgaaagcatgaccttccaccaaaggatttcccattgtttctgagagtgagtgtatttatataaagaagttttctaaccaaagagaaatctgttggatcaaaaaatagaatgatcagtagggtttagtagctatttaggaaattttctgaattcaaaccaattgaatctgagttcagttggtttttgttaatgtggtgtatcttgttcgattaagccttcattttaaaattaaaggtgtcttaaatggagttgcattgtttgaccttagagagatcaattgtgtgtatcagaccaaacaaaattcaccatattcaacaattgtcctagcacccatctcccctccccactcccgacaaccatcatgacaaaagtgcaggaggaaaattcttgacattagcagacagcatgctctgaagcaagtaagagaaggataattcaatatagtactcgtcagtgggcgtctggtcctgcccatttttcctggctctgacatttcatcatgctgagtgagattccatttctaaacttggtgtcattcatgcaacatggccccaagtataggacaactacttaatctgttgttgctcaaagaaggtgcaatgcattacaatgctagagagaaaagtgttcataggaacctaaagagacagtgtgttgacaccaacatgggacctccctaagcaagttgctgagatttgattatgtgtgatttctgccttatgtgcccactttggatgtaaccctgatgtcaggtgtggctcttggaaacgacactattttctgttgtgcaggtatcattgctgcatcttcctctggttgaggacttgttacctggacttttgaattatcttctttgtacatggggggatggcagtatttctctgattgtgatctgtgaacttgccacaggatcatcttggatcctggctgagtgtggaatttccaggcccacatctgacctatcagggctggccgtacaatcagcattttaaataggcatcttggtatttccatgggattctcttgatctctatccacccttaacatcccatcctactttctgcttgttaagactcaggatacttctgggactgctctatggaatgggttcttaggaattctaaatgcatttgcatttcaaagactgatgagaaagggacacctgtccaggtaagacaagtcatcggtttccaactccagcaataagaacttagtttatcagatgtactgtctaactagtagaggtgtgttcgctgtcttcattaaaatgaagccaggttgatgtgactaaattttgatttgatttgctgcgttttatgtggtggcttatacttgaatgtctctataatatctccctgtgtattttagagagtgtgaattaaaacagctgccttgtacattgtaagtgttcaaaaatagtttgtaaagtgttagaataagggcttcatagccacaaggagggtctcagaaggtgatttggctagattataaaacacaaatattaacttttgacttgtttattctttatttttatttgattatttatttatttatttatttttttatttatttatttatgagacagagttttgctctgtcgtccaggatagagtgcagtggcccaatcttggctcactgcaacctctccctcccaggttcaggcgattctcctgcctcagcttccagagtagctgggattacaggtgcgtgccatcacacctagctaatttttgtatttttagtagagaaggggtcgcaccatgttggccagggtagtcttgaactcctgacctcaggtgatccaccaaccttggcctcccaaagtactgggattacaggcgtgagccactgcacctgccgttgacttatttatttgtaaattatcctgttctccacatatatacttttaaaaagcacttcaaaatttcagtgtggttattcaatggccatcaaagtttgttattctaccagaatggtcttatcttttacaagcgagatctaagaaagcacatacagaggcctgaaaagttgatttccctccttggaggagttcctgatttaacttcataaatccacaagagctgacatctcttcatgtccaaccacaaaatgggtagaaaatgatgaaatgcagaagaggcttctaagtcttggtctgcttctgtgatagaacaggagagaggcagcattttatttttaccattattagccagcctgtcagtcacttaaaatttttccgtgaagacacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtcagagcatgtaaatgatttttccgtgaggatagaatttgacagtcagtgctagaaagggcttcagagtttggtaagtctctttggtggactgcatggatagatgtgaaaagataaaccaaatcaaaatgtatattccattgaatcatgacaaattcgcattggtaatgcgaatgatagaatattataggttatgcttaagtgctttacctgtggaagttacttatcagaactccaaattttcaggggcatttgcacagccagtaattgtgcaggagatccaactcacatccacctcagcttaactgcctcttgatgctttcaagcattatgctatttatttcagtgtcttatgtttcagaactaaagaaatgttgaattaaattccccactatatgccgtcagtgtttcagaaaaaaaaaaaaaaaaaaagaaaaagaaatgagcaaggcaggtggatttctggcaaagttttgttttcatttctgtctgatagaaatgggagcacttcctaaaccaaaagagcattttttttttggtagaaatagccatttattaaaaaccataaatctgttatggctggttggtgagcataccttacagtttaattgtaccaagttgaaagtggacacataccaggataggcacacctcattgttccacatgtggcttcagtgctttaatgtgaattataagtacataagtaaagtacatattatttatgcatatgttgtatttatgacctttgggatgcatcagaggttgcttaggctcgttgttctgggtctttcaggatctagattttctatcctgattcttcctttttctaaaaaaaaaaaaaaaaaaaaaaaaaaaaaggctcagttgaggaactcactcagctcactcagtgcaatactataatgggaagagttccatgatgctgccattccagttataaaatggcttcttttagtcatcgtacaagccagcagttatggacagtgtttctctaaatgttagtaataaagtgtagcaggtttcatatcagtatactaattctaccaaaagccattttcagtcccattgacatttgaattctgcccatgcaaattagtggaacttgccatcacccttggcctataatgccccataccaagcatcaccagcccagtgcttctcagtcttggctgcaaatgatcgagctataaaaatactgctacctgggacctgcccctcagtgcctctgatttaactagtaaaatcagagggaggtttgagcatcaggatttctaaactttcagattttcagttgggcgtgtagtggggtgggttagggggaggtaatgtctccaaatggaaatgtctttttggttaaaataaagtagaaagaccaaataagtgatatttggggagagcaatgaatattctaaaaccaatcaatgggaattgtcattttatggttctcctgaatgtgagtgtccaaagtcctcgttattcaaagtgtggtccaaagaccagcctcacttggtaactgttagaaatgcagactgttatgttccagacacacctactggatcagaatgtgcactttaccacgacttccaggtgatttcatgtactttgagttagagaagcactgtcctagtcacagtgatgaggagggtgataagagtggcagaattcactttattgagcctctgctatgtgtcaagcactatgctaagacatttttgtgacatacttctccttaagttgttgccggagttaaataaagtgatatgtttaaaacactaagtgtagtatccaatatcaggtgttccaaaaagggcttatcatcatcatcatcacggtcattgtcattatcttaaatccatggtcaccctaggacaggaagcatgaatctagtttgtaagtgcacgtgatctcctttccatgggtgatatgggttggctgtgtccccacccaaatctcatcttgaattgtagctcccataattcctacgtgttgtgggagggacttgatgggagatagccgaatcatgggggctgttttccccatactgtcctcatggtagtaagtttcatgagatctgatggttttgtaaggggtttccctctacggttggttctcattctctcttgtctgccaccacatcagatgcacctttcaccttccaccatgattgtgaggcctccccagccacgtataactgtaagtccattaaatctatttttctttataaattaccagtctcaagtatgtctttattgcatcatgaaagtagactaatacagtgggccatgtgagatgatgagattgtgaccttacattcaaagataactaagctgtggtggcaatggatgatttgttctcctgaaatctttaggtggcacgggacagaaatccaaatagaattggcgtttgtcaaaagtagaatatattgtactttaaaaatgtgaatgtcagacatttgggggtggggggaggggggagggatagcattaggagatatacctaatgtaaatgacgagttaatgggtgcagcacaccaacatggcatatgtatacatatgtaacaaacctgcatattgtgcacatgtaccctagaacttaaagtataataaatatatatatatataaatgtgaatgtcatgtttctgagatgggtgtcaggaatagctgaatcaaggtgaccaaatggcgatgctctaaggaatgggccttgctgaatctgtacactctgcttttcttggcgtccactttatttcatgtcatattctctccaaatagtggcaagatgctcaccctcaactcaggactgagatcctatcactttgtcttgaccaggagaaaaagagcacctcctttacaatcatgaaaggtaacatcccagggataactctcaggtaccctgtgcacatccctgagccagttactcaagtcagaagcatggatattctgatcaggcaggttggcttcaaggatgaatcaggcctctcatgaactacaagctacggagttctctgaaactggagaagaggttcttcttcaaagaagtgcagtgtgtaatgcccacctgaagagggaaggaatttccagcaggtgtaagggactaatgtccactacaggccctcagttaaaagagttgggtagaaagaggtggggtgtgtgtatgtgcagcctgcattgactctccacttgatgctgtgtacattctgagggcaaaaccctgaattttccttgggtctgccgtaacaaattctctcaatggtgcctccatagggagaaaggggccaacatctgggggttctttcctggaacagtgttaagtgctttcagagttaacaagttttatattcaaacaactccataagatgagtctttcagacttaatttctaaaaccgcaaaaagtactgtagaggagttcagagatacgtctaaagtcacagttaatcaagaggactggtaggattcccagctcacttcaaattcatactcctgtatattcctctttataaataagtcagtgagcaaattatctcattaaaatgtaagtcagagattgccaacttcaggctcacaggcaaatggactttataacttgcagatacagtgggggtattttcatctgtgtgtctatatgtatggatgtatttacaaaataacattttatgtaagaatatgaatttctggcttgtcttcatctctccaggataaaaaatggctaaagttgagttgtggttgtcctctccggcattgcacactttcttcatttcccccagcattcttacctggccagtttctgtcatttatagaacctgtttggtcctggagatatttgagtttgaaaatcctggagtaatagtaccccattatgtcactcatgtacatggtagcctatgcaatgtgtcattccattcttctttaactgttgcaaaacatgccatgtgctctatctgtatatctctctctgttctcactgtcacataccacacacaccccaccccacccccacacacacacacagcaagggaggaatttgcgtttgctttgctcttttctttccctgccccctctcacttagctcactgcataatcctcctctcgtaaccttcaactccacaatgcaggaattttgcatgctctgtccccaaccgtattaataaagcacttaaaagtatgcgattttattcagggttatttatctaactgtctctactgaagtggtacttctgcagctcttcagacgcagtggtttccctgggggcagctttcggagtccgaaagcattgactgaaatgcaaagcccggatgccagctgcacgcgcaagcattccaagcccagtcattgtagccactggagatgggggtgggggatttgagtggatgggtccttccagcgggcatttgggtcatttggcccgtcgccctgcctgcaggctggcctgcacgcagcacctggcctaggcaccctggaatctctcccttcctgtggcagacacaggaaactcctacctcatcacggcagctgcatgtgtgggtaagcccacggtgatgatgacttctgtactggctgtttttactccttgctttaatgatattagctcacgtggttatcctttcccttctagcaggatttttccacagccagacaattctttgcggtgaggaggccaccctgtgctctgtaggatgtttagcagtatctctggcctcaatccacaggataccagtagcacccacccaccaggttgtgatgacccgactttctcctgatactgcctgatatcctctgtgggtgaattttcctggttaagaatcactatcttacaggaaggtggcaaagatgagagtatcagactgtaagttccgcgagagcaggcattgtgtctggtttggtcgtggttgtgtgccaacagatagtagattttcaatacatatttgttgaatgaatgaatgaatgaatgaacttccgactgatcagagctgaggactatattcatcctcaaggtaatataatgattattattcacatattaggaggaaaatcaagggttcctttttatcttctcctactaccccccgctgtcattatcaagtgagttcaactaagatttgcttaatgaaaacctaaatcattatggctctcttaatcagagtacctactatgtggctattctaaataggtgttctcattgaacttggttttctcagtgattcataaagatggttaatagcaatgaaattttacagattgggaaactgaaaaccagagaagtgaaggaatttgtccatggccacacagccgtaagggagtagagacctgattcaaatcttgggctagaaggattctcagaatcttcttttctctttgcacctgattggctgtgcctctcgctttattcagtcaaagctcaattcaggacgacgtgaaagaacattaattccaaggtgaaatgtgcaagaggttaagtgaatttgaccaagtttcccattataatttattttgggggaaaatggattaaaaacataatctctcggttctaacttcacgttcacttgaaaatgaaaagtgagtgttttacagatccacagcttcacgttatctgttgcattttgagagagaagaagatggatgcattggggtagagagtataataatattacaaggctttatatggaaggtcaagtgaggggaagatgagctggaaggatggggaatagcaggctaagaaagaacaatgcataacagatgtatctaaactgtttttaaaaatggttaatagactcaaggagaaatataaagaagggagcactctgaaaggtcagaacaagtagtcaagtaagaagcaaagtaatttaaacataaaaaggaaaatccgcagatatttctttcatgcttcagaaagcgtcggccttaaacattgcagtgtcccagtgatgcattgcaatcttctgcaagacactgaagtattttatgaaggcatactttttcctcctaagttgaggagaccctgagatggcccaaatttcctttaaaaatgaaatgaaactgctcggctttccttacattaaccttaaagataatgaagttttggtccttgccctataaaggatagacagaaagggcctagtcacatcttcctgtcatctatgtagatgatgtccttattcagaagtcattatatgagaatatgagtgttatgggaaggcaggaaggaaggaagggaaaggaaaggagaggagagggaggaagggaaggagagagagaggaaggaagggagggaggggaaggagaaagggagagagaggaaggaaggaaggaaggagaagaaagatggagggagggaagggaaggaagggagagagagggaggaagggcaaaggaagtaagggagagagacgaaggaagaggggaaggaaggaagggagagagaggaagcaagggagggagggggaagaaggaagggagagagagggaggaagggagagagaggaaggaagggagagagagggaggaagggagagagaggaaggaagggagagagagggaggaagggagagagagggaggaagggagagagaggaaggaagggagagagagggaggaagggagagagagggaggaagggagagagagggaggaagggagagagagggaggaagggagagagagggaggaagggagagagagggaggaagggagagagagggaggaagggagagagagggaggaagaggggaaggaaggaagggagagagaggaaggaaaggagagagaggaaggaagggagggaggggaaggaaaggggagggaaagaaggaagggagagatggaaaggagggaaggaaggcctcctcatcctttttttctgcgttcgtttactcatttcacttttttttttaattggacatctgtatatgtcagtcactgtggaagacatttgggaaatgatgactagtaaaaacccaaacaaaataaacaaacagaaagtacctgccgtcgttgtctagtggacaaggcaaaacatcaataattcaataattactccgtgtgttggggcagggtctgttttcttgcagtcatgcctcagttttggcttaacatatcagcttccatagttaacttattcatctgcctgcctctaaatcccacagattttgagatgtagatcagctttgtcctctcaagggtttcacattcaggaaagggctgacccatcaggcatgatgaagcactgcttgacagattcagcctccccagtcaatgaaggaaaggaaaggaaagcaaggttcgtttcatttcccaatcacgtgatggcattgggcactaccactagcttctgatgcattcattctggaacttgtttgtgaaaatcagttgagatactaaatatagaaggggagagccacttggagttgaaagtgacctttaaggccacttctgtcaacttagcaccaaatgcatgaatttacacaactgaatttctgctcttcggacataaactttccccattcttttttggtcagtttgtttttaccctgcagagctgatactgcagagggcagctcattttattcctggactatagttcctcattttgtagaaatcaactttgtcttcccaaggttactggtgttaattttaccttctgatgttaggtaaccagtcactggtttccgaagctgggtctgagtcccagaattcacattgatcagccatggtacctgaacaagcacctctagccccctgagcatcagggatctttccattaagtggagagtatcctccagaatctacctctccagaattcagggtaagataagtatggttgtttggatcagataggttttgtctccatggtagacaagagaccactatagcttaaaactcccattctgccaacagaacaaccgaaagagctagaatacgcttgtttatgtgtttgttttctggtagctgggcaaagaaataagggagggcttggctggtttgtcttgtaccatgtgtttatccttaaaccaatcagaatgaatcaggaatcgactactatcgttcacgtgactaaactggagtattagagaatcagcagggttcatgatgagggagtatagctgtgttcactgcaacacagctcctaagagcaaacagtttaatcagctcatttatcatcctaaccaaacttttaaaaggcagttcctcgggaagttaagcatagaattaccatatgacccagcaaacccattcccagttagatgcctaaaggaaagaattgtaaacagattcacttgaatccacatacacaaatgcttataacatcaccattcattacagccaaaaagcaaagacaacccaaatgcctatcaataaatttatcaataaataaatggatgaacaaaatgtggtctatccatacaatgaaatatcattgagccataaaaaggaaggagctactgttacatgctacaacgtggatggacctcaaaaacactgtggtaagtaaaagaacccagaatcaaaagaccacagattatgtgatttccttcacctgaaatatctggagtaggtaaatccacaccaacagaaagcagattggtggttgctacaggctaggaggaaggggttggggaataaccattaaataggtacagattttgtttcggaatggaatgatgacgtattttggaactagataggggtggtggttgcataacatttgtgaatgaacaaaatgccactgaattgtttccttttttttttgagacagagtctcggtctgtcacccaggctagattgcagtggcacaatcggctcactgcaaattccacctcctaggttcaagcgattctcctgcttcagcctcctgagtagctgagactacaggtacataccaccaggcccaactaatttttgtatttttatgagagacggggtttcaccatgttggccaggctggtcatgaactcctgaaaactgtttactttaaatggttaacaaccaccacaacaaaaaccatggagaccaagggagaaaacttaagtgagatatataacttgcttgagctatgtgttcattttataaaatgggcaaaagatgcctatgtctttaggttataacaagcttcaaacaagtgaatatttataggggaccaggttcctggcaactattaggtgctcaataaatagcctgcatgcaaatacctccccacacacatatgcccacttgtacccacgtaattcttatttaatggtgttcttttaaagaatgagataacaggccaggcataagcggctcatgcctgtaatcccagcgctttgggaggccgaagcgggtggatcacctgaggttgggagttcgagaacagcctgaccaacatggagaaaccctgtctctactaaaaatgcaaaattagctgggtgtggtggtgcatgcctgtagtcccagctactgagaaggctgaggcaggagaattgcttgaacctgggagggggaggttgccgtgagctgagatcacgccattggtcattacactccagcctggacaacaagagtgaaacttcatctcttaattaaaaaaaaaaaaaaaaagaatgaggtaacagaaacaaagaacttacctagcacatgatgttagcaaaccctgtcaaatttgtattcccatatttctcaaaacttgttcttctttccctctccacaccggtgattgttgtcaccctgctttcctggactgctaaaataggctacatttcccttttcaatcccttttgcttgctcttgatgttcccaacagcggccaaagaacccatctcacaatgtacataggatgctttcccttcccagttaaaaaccccactgtacttagagttaatcccaaccaccttcatataaagccctggaagtctggctcctgccaaccttgctaaactcatcctttttttttttttttcctgattcttatcccattgactttgactgtttctaagctggctctatcccaagtgaaaagtcacctcttcaaagaccttttctatttaaaagaattatcccagctcttctatattcttttccatgacatgttattcacgtgcttccaagtcctgatcaccatttgtaattttaaacattgagttgcttttccttgctctttctcttattcatgaaggcagctctgctgttgaacacaatacatggtagacagcaggccgtcgatcagcacttgttaaatgagatcaatgtgtggaaattattattaaagtcctgaaaattttacaaagtctattttgctctaatgtgtacattggtggtatagtctggggaatacatgtatagtttgcattgtggacatccgattgtttccctggatgctgccctttcaacaagaaatgcgaccttagcaaaagatgggggccccatgaacttccaactcgtcttttatttatggtatatgtgtcagagaaacataacaacatttgggaatttattaaatggcagttttctcttcaaattcttgctctagtttattgtgcctaatggagtcttactaagggcaaagctaattgacaacaaggtttatttctgccgatcttagccaaaaagtcaatcaccactcaacgagagctactctgactctttggccaatggacaaatttccatcttgactggcttgactggtcctgggagaatagaagtgaatgagcttaattctattttgatacttttcattttcagcaaaactgagacaacatcaaggagttacattatcatgagaagagaggggttgcatggaaattatgtcacaagaatgcttggtcaattttcattgcattcagctctattcacaaaggcctgttttgctggcagacgcttttgtcagatatgtggctcacggcaggcaatcaagctgtggcatgttgcagagggacagtgagggctcacatgctggaggcagaggttactcaggccaggtaatgaataaccccactggaagagcaaaagagctcatttctcagtggtttatcttccagtgggttggtgttgtgtataatacagtgagttgagatgaggaatctatttggttttggttccacccctttgccagcaaaaccacaaagtgggaaaagctaacctttgggaggtaaaagctaacagtgcaagatgccatcaataaaataagctccctcatcagtgaagaagggggaaccaggctcaaagtttgtcttctaccaggaatataagcatcgtgtcctggatagtatgaagcatttaaccatgaagtcttctgttgcaaatgacatgtgtatacatatgtgtgtgtgtgtgtgtgtgtatatatatgtttgtatgtgcttgtgtatatgtgtgtgtttgtgtgtatgtatatatgtatacatattttatatatatatgtatatatatatgttatatatataagttgctttcaccaaatccttgtaaataccctgtgctgaacggagaagtcagaaatgggtaatagactacattcaaactcattttcaatttccaaaaatatgcaaggcaccccatttttggtacgtggatgttttttagcatttaatggataacaattttgtatgtcccataagaattattcacagacatctcccaattccattttcagagacttactgtagacttgcttttatgcctgtagcttggatccaagaaatttatttctacctctgcagtccaaaaaacggaatgtctaacgattttttgcaaggcaagtcgaagtgctatggtggaattcttcttagcaagacaagcttcagtggaaggaagaatgtaaaacagaaaaagttctttaagaggtatataaatctacacatcggtagtagtcacactaataataaacattcatttggcatcatatatttttaaagtgctttaaaatgttgacattccttagaaaggagagaatagctctgggatgaggatttttattttacatttcagggatgggttacacagaaagaaagccacttgttcattattgactaagtgtggcaaccagtgtgaccattccctagtggtatttttggctcttggcttagaacagggtatgtatccaggaggcaagagaatgagtaagtgacctactgtactgaaaagaacagacagagatgtagtcacaaaccagtttagatgagggacctttgtttgtaagatgtaaacatcgtaaacaaggagatgctggtagtttttgacattttatgggcccccgtagcttcatcgcttatgtacattgaatggatgtatgttgtgatggaaaggcagtggctgcgtttgccctttcaattgatgggcagccatatcttgggatgaattagccttttgtgggatgaatatgatgcctccctctgccatgacatcaagaatatcctctttgagggttggagagaagttgtctcttttttcctgccttgcaatttatatattaagggttgaccaaaaattgttaaaaatgtttaaagctaagtaatatcctgtgctagcctgaactaaaaaataatgccttattctgacaattccagtttttacagttgaaggctattaatcaatgaagcagtgtggatccatataaatattgatcactgtctccttgccctcctgtgaatgttctctcttaatgacagccaatttcaatattcattagaaagggtgcattttctggcttgcaccattgctgattagtaactagagagatttaactagaccatggtcattttgtataaatagttcctcagatcaaaaagatcctggttattgtctatctggacttagcttacctcttcaacatttcagaaattagagtgttttcttgtttgtgtcatatcctgctcacctaaacattgctactgttaagcattaatcttctcatatttaatatataaaaatcaaagtaaatattcaagagttatatttagatctgtaaagggaagcccaagtgctttgtatgaggtgcgaactagggttaataggatgtatttaacaccatattgtttcagctcaagttagggagagaaggagatcatgtatgcaaaaagtagaacatttctccccttcctattttgtctagaggggcgtaccctcttttaaggtattgtcacatgcacaacatctggccttcagttctcctctccgctgtcatgcaatctggcagaatctctttctgctccatggttcctaaatgcatccatcccattgccattaggattctacttttggcattttccccatctgttttggtaattactgtcagatgaactgatatctctaagttgaaaatggccaccttttaaggtagcacattgtagtcaacttcccaaatcatgaagtctatgtggcttttagtagttgtttgcagaagtaatttagtaactttactttttcttttttttttaatttctaagccactgcaagcacgcaccagccttcagtggcctgaattattcagcagtcattaaaaatgcagtcagtgataaggcagacagtccttgtgcctgggtttgtcaacatatcttgtcctcagcaaagactaggttcactggaagcacgcaggatttagttcaccttctctagaatggctgttgttgggaggatttctagcaacattactataaatgatctgcctgcctctgtgttgtggtttataaactctgtgtaactaggataagctggctttggaagaggcaagccgttctttcactagaagggagaggttattgcatcacccatcagcaagagaggaattcaggagaggtagagagctgtgtggggtttgggtggcagccagctactttccaaaacttcccaggggctgcaatacagccgccaacccaaatgtcattgggataggccagcgtgccagatgccatcacagaaaataacttcccttgcctggcatctgggttcttgccttgtaatccagaagaccacatgctggatcagctggtcccagcggggaccatgagctcttccgtcctctctccctccctgtctgctgagcatttgaatgagtcatcagagtgcagaatggattttggccatgcccttaattgagtgttctgtacatacaataataattaataataatttgaactgatccttctatagttttgtctctggaccaggcactgctctaaaggctgcacagattgtaactcatttacatatgtaacacatatctacatatctcattagcctgaagcacaatagaatgagaaaagtgaaaagcaaagtgcttagactctagatttggaccaactggcttcctatgtcaactctgcctctttcagtataggtgactttagaaagtaaattctgctttctcaagccaagcgtccatgcacagacaagggaataaacaaaacgtggtgtatactggaatattattcagccttagaaatgaaggagattctggccgactgtgtggtggctctagcctgcaatcccaacactttgggagggtgaggcggacagatcacttgaggtcaggggtttgagaccagcatggccaacgtggtgaaaactcaactactcaaaatagaaaaattagctggacatggtggcacacacctgtgaagccagctactcaggaggctgaagcatgagaattgcttgaaccctggagatggaggttacagtgagcccacgtcgcgtccctgcacgcaagcctaggcaagaaagcaagaccctgtctcaaaaaaagaaaagagatgctgatacatgctacaacatagatgaaccttgaggacattattctaagtgaaatgagcttgtcacaaaagaacaaatattgcatgattccacttatatgaggtgcccatagttgtcaaattcacaaagacaaaaagtggcatggtcgttaccaagggctgggagaaaagaggaatggtgagttagtgtttaattggtacagagtttcagttttgcaagatgaaaagagttctggagatgaatgttgggaatggctgtgcaacactgtgaatgtacttaacactactcaactgcagacttaaaatggtaaaaaaaaaataaataaataaaataaaaattaaaagaagaagtaaattctgctttctgcacatctgccagctgcccttgtctaagttcccaaaacagattctgctttttgcttccacagagcctttgcatggttgtttccccttcctgcaatatttacttagtactttttcctaggttactctcctcatctttccaaccttgggctacacacgcacctttaggaaagcctacttctgtgttcttcccatcttgtgtacgttccaaattctgaatctccaataaaatgaatatgcatttctttctctctttttttgtaacttttattttatcttcaggggtacaagtgcaggcttgttacataggtaaacttgtgtgtcatgggggtttgttgtgcagattatttcatcacccaggtgttaaacctagtacccattacttgtttctcccgatcctgtccctcccctgacctccacctgccaagagaccccagtgtgtgttgttcccctctatgtgtccacgtgtttttatcatttagctcccacttatacgtgagaacatgcagtgtttggttttatgttcctttgttagtttgctgagaatgagagcctccagtttcatccatgttcctgcaaaggacatgatcttgttcttttttatggctgcatagcaccccacagtatacatgtaccacactttctttatccagtctatcattgatgggcatttaggttgattccacatccttgctattgtgaatagtgctgcattgaatatacacatgcatgtctttttattatcattttctcctttgcctttcctaaaccatgcagtttgatatatgatgaggctacttctaccattgatgtaggtactgtgggtgccaggatgcccaggaaaaggtggaatcagccagtaatcccagcaatttaggaggccaaggagggtagatcatttgaggtcaggagtttgagaccagcctggacaacatggtgaaatcccatgtctactaaaagtacaaaaattagccaggcgtggtggtgcatgcctgtaatcccagttacttgggagtctaaggcaccagaattgcttaaacctgggagctggaggtttcagtgagcctagatcgtgccactgcactccagcctgggcaacagagcaagactgtctaaaaaataaataaataaataaaaattggaatcggctgggatgatacctcaacaagtgaaattgtcctgtcaagaccatttgcatgtgtgaaagaataaaagaaaaacagaaaacactgagcttctctgaggctttattgccccctgataagaccgtgagaactcatttgtcttatattagatgattattttactcttctgggtctttgatctaggcagttagctggttagaatttgctgatgttgtattcatgtttctttgaatcagcagtaactcacttagggatgaaaatggggcatttggcttataagaagaaaacaaatatcatttatattcatttttctacttgaaactactacttgaaaactgggcccatagagttcgttgtgctaaaaggaacatttctcattggtagttagtatttcaattgtaatcaaattccaaaacttcctacctgttgaaactataagatgatggtgacgattatttgagactgagcctagctctgtcgcccaggctggagtgcaatgctgcaatgtctgctcactagaacatttgtctcctgagttcaagcgattctcctgcctcagactcttgagtagctgggattacgggcacccgccaccacgcctggctaatttttgtattttcagtagcgaaagggtttcaccatgttggccaagctggtcttgaactcctgacctcaggtgatcctcccgcctcggcctcccaaactgctgggattacaggtatgagccgatgcatcctgccgaatctataagatttaaggataataataatgaatgtttacggagcagtgttcatcaggtagtgttctaagtactttacatatattaatgatcttcactatgttatacttgtatatcaccatctgtgatcatctgaagcccttacagtttaagggaaaatctgcatttgatacatatagtgtgtgttaaagaaacatgttaaagatgaaggaggagtatgttattttattgtattgatttctgtttctaaatactggggttttcgtggtgttttttgtttgtttgtttgtttttgtttgtttgttttgagacagggtctcactttgtcacccaggctggagtacagtggtatgatcacagctcactgcagccttgaccttctgggctcaagtgatcctcccatctcagtctcctgagtagctaggactagaggcattcaccaccacacctggctaatttttgtagttttgtttgtttgtttgtttgtggagatggggttttgccatgttgcccaggctggtctcaaactcctggactgaagcgatccacctgcctcagccttccaaagttctaggattacaggcgtgagccgctgcacctggcaaaatattgttttttgaaactcttcttgaagtactaatgttgctttagatcttaaacagcagcacaaaaagtttctaactttgttggaacattctacttttcccccacaccttcccaaacaattctcttaatatacaacaatatctgttctggctatcgtgaaaattaagccactggatttgggttggaaaagaaggtttatttagcgcagtttttagtatttatatcagattgccatttctggcttgagacccgaggcagaagtatcccctgcatttggaaaatgaaaaatccactggaggattgattattcataaccctgaaatgtattgccccacctctaccataaatcacacggagtttttattctcattagctgaattctggcatctcagtctcggcactactatttattctaattctctcagcttgagtaatgggtgtggcccaagcaggaagcaggtcacctcctggcccgttggactatcttggaaagagcatgtgattccctgtaggattaggggatttgcagttcaatgggcaaattatgcattccaacgtctaagtgtggttgtttaattaaaccctttggttcattcaagatgactaaaatgtttcttgaaacaggacatcttgaaagttattaaaatttcacagcaaacacttttatggcaggaacttttatgaattttgtttgggttggggcattgcaagagggttacttaaaatgttttatctggaatttataataaagaaaaaacatttcttctttatgttggtcatattttcagtaagagtgcattacaaaaaatctacatctggatgacaaatgtgatacaaatggacaaatatatatgcatatacacaaacacacacacatgcccattttctcatccccccttctttttctctttcaatctgtctataaatgtagatactcacatatacatatatgtttatacatatattaaatatgtaaatatgtatataagtatatatgcatataaatatacttatatgtgatttgtgtatacataattacatgagtgcatatatacctaaatatgtatatctgcatatgcgtgtgtatatatttaagggttttcaactttggccctcttgatactttggattggtaatccctttttttgtgcagtgtccctgaccactagatgctattaccataggcacctcagtgataacaataattgaaaagtcaccaggaatttccaaattttccttctgttgagaacccctgcttattgcttggcacacatgcgcacagagaaacccatatatgtgtaggtcatgcacttactgtaagagacatggaaactactgtctcctagtttatccccaaaggactgacaagagtgttcactgaaaattcagagacagggttgcatgtaaatgtctgaataaaacacatggaaaaataaataataggcatgacatatcatcattggaaaggaaggtaccttctgatgcagacaggttgtgccacatgacagctgtgtgagcttgggcaagaaactagatctctctgagctttagttcttttatgtttgaaatgggcaacatcatgattatttttcaccacttgttgaatttatagatacagtgtacctccccctgcatcctcattacacattgactaaggaaatggaatggtctggaacacgtggcaacttggacatggggaggtctcttcgccattggctgagagtaagctgaacaaactttccatggtgacagctgcaggatgctcagcatgcagtcaattcagtccaacatccgtgcttcgtgatttgcatccatgtgacttgaagcagccagttggaccaggtttctgattgagtggccacgtgcatgatgggttgggttggactaactagttgtctgcaagaactggctaaacggctcagccaaattttctgtttgttgattcagacccgactgactttgccaggtttggactgtgctggtgagagagatatggagtctgcggacagtttgcaagcagtgcctctcgacattttcatcctgcatatggggctgtgtcggccttacctgtctaccttctttatcttcttccttcatttgttctcttcctcctcctcctcttgtttttgttacttggattttcaggatgtcaagccctggcatttttaatataaattggtaatataataatatattccctttattctttgtcattagctgaacgttttaggaatatcaatatagaatacatttgaatgttttcattaaaattgtaacacacccagtattaaatcagaaagtgaatgttcagcaaacacatattgatctcttgctacgtgccaacaactactccaagcacttggcatgaatgtaccacatttattctccaaaccagcctataggcgtggtcagggtgtgccacgtgacagctgtgtgaccttaggccagcaactagacttctctgacctttagttcttttatgtatgagatgaagagacatcatggtcactttgtaaaatttattccaaaacaaaaagatgtggaagaaaggcatattacctttggttgacattatctttgtttgtaggtgaagaaactgaggcttaaaaaattcacatatgttgtggctaagcagaagggctccccaggaagttgaccccttactctttattagtagtagtattaatacattttgagagaggctgtcactctgtcacccaggctgtaatgcagtggcatgataatagctcactatagcctcaaattctggggctcaagtgatcctcccagctcagcctcccaagtagctgggttacaggcgtgcatcatcacatccagctaattttattattctttttggtggagacagggtttcgctgtgcttcccagactggtcttgaacttttaggctcaagtgatcctccttgcctagcctcccaaagtgctggtattagaggtatgagccactgcatcctaccccttattctttgttcttaatgattatgttataatctgggatttcacataatcaaaactcttaatttctaatggatttaagagattcattaaacctctgaagtcacatacaaaactcgataactaacatacatttcttttttcctggagagaatgttcatagcttttaaatcaatatctcaaaatgatctttgttttcacagcaagattaaagataatcattatgtaataaaacttttattttctgtttcttaggtcagtctacagctcaatcttaaacagcagtattgtcatcaaagggtaactccagagaaaaaaaatcagagtaaataaacatttataataatatatctttcatcccttcttcagagtctgttctaggaaaatgccaaagtattccaaaaaaaaaaaaaaaaaaaaaaaacacccttgggcttttcattaactacacttcagtccttgagattatcttgatcttgaaagttgctggcctttgagcaacttcttcaaaccctcaagatgcatccccatggaccatgctggtcctttttcctgagccagccatttcagcacacatctttgtcatttcttgtcatattgagatcaagtttggccatcctctttgcaaaatcatattcagttttcttaagtaagattgtatttttggcatgcttccattagagtcagagccagcggtggctctcagttgcaatgctcctagagaaagggaactttaattaggacacaatggggttggcctagggctcgagttagattcagtattcaaccaatgttgctgcttaagcctgtaaatgtatggtatgcaacttgtgggtactttccagttttcactgactttcttccaatattgtgtagtgtgtaaagatcggaggtattaaatccaggacctgggaggtcatcacactcgaaggaggcaggctgggtcatcagacatatggctgtcttggttttgtttccttgttcccacttctgctcatgatgggcctaaataagagatattcctctactgtaagaaaagctccgtatcccaagtgaagctaattggtaattggtgtttcatgtcagaggcacagtagggagcagtggggattgtggcaaagtgaggaactcatgcctgccttcacagtgcagctgctcctcagctgcataccattttcatgaattagaaatataccagactttctgattgtttacctaagagagtctgaaaagtcttatttctaggtgctgtatgtccatttaattgttgttacttagtctagattatttttattgataacatagaacagtggtcttacatgtctctctagatcctaactaaaataataaatatcttatatttcatttgaaaaatatttcatatagttatagaattctagattttgagtaattttctttgagagctttgaagatgttatttcattatcttttgtttcctgtactcttgagtttttttaaattttattttaggttccaagatacatgtacaggatgtgcaggttcattgcataggtaaacatgtgccatggttgtttgctgtacctatcaacccgtcacctagtattagttgaatgtttgaaactcaaggttaaaccatacctgggggtgttatctggtcttcaattcaccactgttgaccaacagaggctattatgatttgcaaaacgtattttcataatcaacaagacaaaaataaataaaattttaaatctgatttttataacttttctgagaggttaaacttttggagagctagagaaagagctatgctgataaacaagcttacttagccttatgtttttgtttgtttgtttgttgaaagatgtttgcctgctcacttaaggatacttagcattagagaaaagtagcttttttgaaaaaagaaaataacttcgggttgccctttttgtccatcagtcttgcatagtgctttagacagcacttcatacactcatgcaactcttcacaaattaccaattactttcccctttgcgtttatctaatttaatccctacagtcttgcaaatagatattcaattctcccagcccatagcagcttgaaacagttcaacaaacacaattagcccatccctgaaaaaaagtatagattgcagtgtaaatagaaatttgtttttccacttcaagtgtggcacaaattatcacccaccttagatgaatgattaattccacaactgttaagtatgtttttacttttatctaagcaaatattttgagagtttttttcataacttagtttgatacctaagctggtaaatgttttgttcaagtttgctgaagccaagactaatttagaattagggaagttaggactgctttcaaatttgagagaaaatttggaaggaatccttagcctctccacagccaccaccctaatccaatgcaatccaattgcctctcacctgggcagctccagcagcaccctccctggattccctgtctccgtccttgctccctggcatcccccacagcaaagcagccatggagattgttctgaagtgataacccgaatgttttcctcttgaatgtgtgatttttttagtggcctcctgttgaaagcagaattaaatcaaactcgttgttttgctttcaggctctgcattatctggcctctctccagtctctcccttataactgtaccaaaccatggtggcatccttccttttccacaaacgccaagcttattatgaacctagggctttttgttgttgcacatctatttattgtcagactgtatggtcacctcctttttttttttttttttttttttactgagtttgaatgcaattattccttccctttcctccttggtaaaacagaactcttggagttttgttgtgctgactgcggtggtatcagcaccaaggacagcgcctacgtagcacatccagaggcttattaaatatcaggttcaacgactggctgactgactgatcaaagagagctacagcataaaggcttcagagtcaaagttgaactccagttctgccatccacgagacaggaaagttatacaacctccctaaacctcaattttcccattttacgacagggatgagaacagtgtctcccacattaggataccctatgtattcttttcctattggtccccagcaatcacaaatctaattggcaggtaacagtgagcacttgtttagtgcatgtgtctgtagtacaatggggtccttgatttaggctgcactcagtcatgtgtctgcaggtcagctggccctcaagtgaggaggctcagctttggagggaactctggtccctgtgtctcaagtcctctgctggagaatagtagctagtcagaaatgttctcttggtgaaggagaagtgcaagagaaacttctattgtgcaaacgccttcaagcctttaaccgcatcacactcgctgccggttaacattccttaaccaaagcaagtctcacagacacacccgcagtggaggggacactcacagccaacgggtaggaaagtacactctgcccatggaggtggagaaggagcaaatactcctctatggtgatctaccacacactaagagttgtgcaagataatgagtgttaagttcctggtatgtgataggcactcagtaaatgttagctaaagttgagaattactaatttttctgtaagaccctgtgcctgccacaataatatgaaagtaatgaatagttttatgttaacaaaagctaaaagcccccaggtcatccttaaatgaatgtatatcctgattcaggaatgccgtgattttaagaatacattagtgactgcttgtcatttacacatctcttaatttagctgaaatggaatacgggaaacatagcctctttaaatccaggttaagtacatttccattgcagggagcaaggtcggtgctgttcatctaggtattttaaaatgtggttccaaacactgcatgttctcacttataagtgggggctaaatgatgaggactcatggacccatagaggggaacaacacacactggggcctatcagagggtggagggtgggagtagggagaggatcaggaaaaataactaatgagtactaggcttaatacctgggtgatgaaaaaatctgtaagacaaactcccatgacacaagtttacccaaataacaaacctgcacatgtacctctgaacctaaaataaaagttaaccttaaaaaaatagaatatggttctggaaggaagaataaccgctgattttaggaagaactgtgaatgaaggcaaagacttcagagggagatggctctcagttttgagccttggtttctttatcagttagggatattaccagctctctgatagggtccctgtgatgtttagaaaagggtctacaaaccattaacacagtgagtggcacatgaacggctttgcaaattcttgctgcctttcctacctactgctcactcccttccttgttcataaaggaccgtgctgttggccattttgtcgtcagctcttctagtaggatgccctatgtgggtatcagaatacatttgtgcagaatcttctagctgagtcccttcatatctttccagtcatttgggggaaaaggtaggatctgaatgaacagagactttcacgcttacacttgctggcttagctgaattaggggtagcattacttaatttcacccatcacagatggttttacctgtcatctcagccatgagccaccttccttccagaactaggcatttcttctttatggtgagtgaacttagtttttgaccttcctttttataaaacactaatagttgcttataggaaattcaagtactgcagataagcaccaagaaaattagagttgcatgttattcatcatccagagataatgtgaattagcattatcattaattgatttttctgtatgtctaggcagagatatatcagggaaaatgctatttataacagttgcctttttgagtaatcatttagctgtcatctatttgtaatctgtatgtatatcctacctatatacataacaaggcaaatgttgctatgtatagccaacagccatcgcccaagaaaggcgggtagcaccatcttgttctaggagaggtccctttgtctgtggaatcccagataggtttgattttgcaagactgagagtgggagccagggaatacagcactgctctgcataatagagggagggaaaagtagtgttccaggaataggactgataggagagggaggggaagagagaaatgggagagggaaaggaaggaatcaatgctgaaaggaacagaaagctgggggttaggtggtatcaccaccaaccttcagctaagttgactacatttttaaatgtttttgcaagggtgggtttgtttccattcccctcttttttcccttctcttcattgtctttttctttccttcttttctttctattggatgaaccctgaaagtggtgcaatagagaataaataagataggaggagcctggaggacaataagaacaaaatctacctgagaatttgcaggaacctggggacatcactagacttccaagggccatagaaattggagctttataccaattttacttacatcaccaaggagaaagcatttttccagctatctgaattctctgtctttctctctgacttcccacattgtatatcaactgtttatatgttttgtagttttttaatatagctatatattatgaaaatttccttcttcataggcttctttctttaaaaaaaaaaagagcctgtaagaataatgaaagggctgaagaataaaatcattgaatgggtaccagatttatttttatgtattttttatttttggcacagtcccaattgctgagctttttcttgtgctatctctgattttccaccataacaaaccgacagtgatgagcaacattgtgtctatatcttaagcacacccaggactttctggagtcagttcctacaagtggaaatacttgaataaaggttatacaaatgtttaagccttttgatacacattgttaaatgatctcttcagaaaggttaaaccaatttacactctcaacagtagtgtttaagagactctttctctaaatctcctttaataatgaagagaagcattataaaatcctttccaattgccatttttataaaaaatagaacctatttgttttgcacgtatttggtaactctaagaatccctccccctttttttcccatagggttttgaaccagttgtgtttcctctgggaaaatctgcttcttcatgtctttcaagccttttattgattttcgagagaagtatctttatgttttgtttttaaaattcaaatgtggtgtttctaaatggtatgtgaagcatgatttcacttagtagacatttgtggattagccattaggtgaaaaataacactgaagagtaaaacaaatgctttttttgctgttcctgggagcgtgggatgcttatattaattgtttactggtgaccatggatgctgacacaatgattaaatgctttaaagccagcttaatgatataaagccatttcttcatttgtgtcttctaagtgaaatccttcctaagtgaaccacaagagtttcctgcttcatcgcctcagctgcagcctcagctgctgtgattacacttaccttgtctctgctttagttagtttttatcccctccctccaagaaagtaaactacctgaaggcaaagactaagagtatataccccagggacggggatcataactatgtacacagcagacactgagcaagcatttagaggagtgcattttaccattagactcttgaaggacgtcatactgaattttcagaattttttatgtacccagggcattttatgtgaacgtatttaccagggagggtcatgctgtgtatgacctttatgtcattctaccaaagaatcaggcaccaagacagctgcagtttctctggctactctgtttccttcttttagggaacttaggacactgggtgattctttaaaaaaataataacgaattaactttttgaattgacaaagatggtatacatttatcatgtacaacatgacgttttgaaatatgtatatattgtggaatggcgaagtcaggctaattaatacgtgtattatctgatatacatttttgtagtgaaaacacttaaaatctactcttccagtgattttcaagaacatgatacatgtcattaactatagtcaccatgttaaacaaaagatttcttgaaactattcctcctatctaactgaaattttgtatccattcaccaacatctccccaaccctcaccaaccccaatcccaccccagcccctggtaagcaaacttctattccctacttctatgagttcaactatttcagattctacatgtaagtgaaatcacgcagtatttgttcttctgtgtgtggcttatttcactcaacatgacatcctccaggttcatccacagtgttgcagttgacaagaatttatctctttttagggctgaatgacattccattgtagatacagagcatacttctgtccgttttttttttttttttctgtgggggatggagttttgttcttgttgcccaggctggagtgcagtggcgcggtcttggctcactgcaacctctgcctcgtgggttcaagtgattttcctgcctcagactcccaagtagctgggattacacgtgtctcccctcgccgccatcaagcccagctaatttttgtatttttagtggagacgaagtttcaccatgttggcttgcctggtcttgaactcctgacctcaagtgatctgctcacctcagcctcgcaaagtcgtgggattacaggcatgagccacagtgcctggtcatgtccattcatctgtcagtgcacgcttaggttgattccatatcttagctatagtgaataatgctgcagtgaacctgggagtgcagatatcccttcaaaatactgatttcgtttcctttggatatatacacagtagtgggattgctggagcatatggtagttctatttttaattttttaaggaacctccataccatttttttcataatggctgtactaatttgcattcccaccaacagtggggcactgggtgattcttaaagagagtcttcaaggaaaatgcaaaagctctacagtatttgggtggtgagacagaaagtggagaaggatattgtgttctagcacactgcaaacatggttactgaatttgaaattcagaaggaagagaagggatttattttccagctcagaattgcaggtagagcctagctatgagaactcctatttcttacatcatcaaaaaggaggaaggagctggttctcctttgagagatttttgtttgtttcccccatatctccattcatttattcgttcattcaaaactttaaattttaagcttttcctccattgacttgaagtaagtggaaatataacttataaggaaagtggaaaacaaattacattcaccactctgtgcttgctcattacaagtaaaggttacacatctggctggggcagaggtcttcaactgacagttcctaggccttttgtactttgctgtctttttgctgtttcatgttggaattcatcgtcagcactgaagtatctggaaattttgcacagatctttatatttctggcttttcattaaaagttggaagatctgacaaagcttgtccatcatccaatataacagcaatctgttgagctttggtagttgttaaatgttttgggtgtagcctgagtgtttcagttaacctgctttactcattggtgtcagctacttgtcctagacgtaacctttttcatttacatcctttttttttttttttaaatttgagtcacccaacgctaaaggtatttaggttggctattattatttccacttttgatggcattaggtatctctgggctaatgttacatagtaacgtcagatctgggatgtgaacgtggtacctaaattcagaccaagtgatctttccctaactcatatgacctacccatatttggcagagccgttatcttagagcctccaaaaatgcatgtgtgtaatcacacacattttgtaaattttgtaaataagcatgcacatatgttaaaggaagttcagcatcttgagcctctgataataagcccttctgggtaaatgagtgttctgcatcttttccatctttttcatttacgctcttataattacctttaaacacagcatcactggacacagcaaacatatctaggtcaatctgtttgcattttgatggctccgctggataaaatctcttctccactttcttgtttctttggaagaagcagagaccaagacaaaagaacctgtggttcatagtggcttcaccattcacaggtattctcctgggggtcaaatcaacaaatcattctgtcagttctgtggagctattcagaaattcgtgttgatgtcagtggcaacaaggaagagcggagacatgtcaggctttggtttctggttcattttcactctaactgctttgcatggtgttctccggcttgacaacccctcaacctcttccttgtccttagggtaaagtctgagttcccaacgagacttcaggatcaatcctctgcctatctatacatcattgaccttgtcatcacttcctttctaaccatctgcaaaacattaaatgcactctcacctctgagtcatttctggatgtctcctctgtctgaatgctctcatttccagcctcttttcctttttctgttcagctcatttctacatgaccatcttgcctatgctttgacatcacttctccttaccctacttctcaggtggcctagaaacccctactccatcaccacatagtattctgtgtcgatctatggagcctctcgttacttaccttgctgcctccttgtgactgggagttcatgatgggaaggaatcttttccttgtgtctccaacactgagtccaaggtctgcacatgagagctcttgagaaatgcatattggaggatttaatattttgttcgttcattacctgaatctgaagagtctttatataggagctctcttgtatctagaaaggggactattacagtgtgagacagcaaaggaagaattgccttgaaaatacgttatggtgttagcagggatggaaagtgtaaatcctcctaacatgtttttgagagtttacttcactttgggcattgtgttgttgtgctaagaatgccctttacttccacctgttattttaattctcacatcaaccctgtgacccccttgtttgtcaatgagaagaccaatgagaaaagaaatgaaatagtttgcctgaaatcacacagttcattgttggagaaacaaggatcccagaaggagctgtttggcagcaaggactcatagtattaaccactccataaagaaattcttgactcatttgcctttagcccttttcttggattactaattcagcaggaagaccaaccctgggctccttaggttaatcgggtttattggattatctagcacatttcttagattatccaagctggaatctccattgccaagatatcactggcctgattaaacaagctgcggtctctaaagactccaaatgtcatgttcctgtctctctctctctctttttttttatcaatatatgcccattttaggtgttattttattatttctctaactgtaccaactcatcattgtgttccaaaggacctcccaggtatataatcctctctgttgctacttaaaagaggaaaaatttttcttttcaatcctgtcttctgattggaggtgaaagccattcaaatctaagttagaaagacattcacaagccatttttgcaattgttattatcctaaaactaaattataggcattacgtctctgaagcattattgctcatacctagaagggtgctttatgttgtatttcatacaatgatgaacaagaagaaaaagactggaagtttagaatgagtgattttggtctgaaataggtatgaatttttcaagaatgtggtcactgcattttgtaccatcatttctctagacatttcaaatttcaattcactcattaatggctcaaccgttaataagaaggtgttttccacagttttcttgagttttatttgctgttgtgtcctgagtgtgcataattttggaactttataacagtagtgtttttaatattttattcataatattaacgttagctgttatttagggagtatccccaatgtgccaaaaataaccccatctccgatctttgcaacactgttgaaaaatagaaagatagtttctattttagacaatgaggctgagggtagagatatgacttgcttagtgataaacagctggttaaagcctgagacttaataggaaccaaaaattgcctgaccttaaactctgtgctatttccattctatcacactgctgtggaaactttgagtacaaaaagatttcgttaaaaggatgttaattgcagagttgtaataatagtgactacttggtaacaatataagtatccactgataggggattggtttaataacattttgttatatccacataatgcaacattatttaatgtttaaacatgcactttaaaaataagtgaatatgtattgccatggcaagatgtccagcttatatttagtgtaaaagagattgaaaaagaatttgcaccacattatctatttttaaagcatgtttatatttgtgcatgcatgggcgtatccctaagcaaggtctggaccagcactgttcagtagaaatataatgcaagtcacatatgcaaagtaatttttttagtggttgaattaaaaaaataaatgcatgaaatgtttgttttaataaattttacttaatatatccaacatatttcaatatataatcaatatagaaatattaacaatatattttacatttttttgtgctaaatcttcaatgtacatttttatactgacagcacgtctcatttcagatcagtcacatttcatgtgttcaatagccacatatggctttccgttaccttattggatagcactagtctagaggaaatataataagatcataaagtgttcactttgggatggggtgattatgtgtgttggtgttagtttattgtctccttttgtcttatttgcatttcccaaatttccataatgaatacatactgcctttgtaatttggaattaaaatacactgttaaagtcatcattcatttttaatagggagtggtgagcttctaaaatgcactgttaaaaataaatacatagaatgtaaatccgtgacctattttcagtcgaggcgagaagctggagatggtatgaggttggctctcctctttactcccttgccttccagctctgtaacccctgctcccaaaagccaggcctctggggttctgatgaggggagaggttaagcctcacctccacagtcagcgagcagatctctgatgaagccaccattcctaccagaagttctgaggtttggcctcagattcattttcaatctctttgaaagacaaaggcggctgtcatgggagaagcctacactagtttgtctcaatcttttatggcattattgctgacctttcaccaaggagcctttttagaccttttttcccttcctaatcaccattccccttccctcattaaattttaataccacacatacactgtatgtctgtttataccatgtaaactgtgtgtgcgttgatgtatggtggccttctggatggccacaaaccaaagtcatatctaaaatttcttaccctcttgtaactaagaatccatttccacccctttagggtaaataatcgctccctgtctcattgagaaggacgcccagggccatgttcactggtgccaaatgtcagtaatacggttgtcctgtgagttgcatttaacttcgaatcttggaccagtcaccagctctctcaccgttctacgcacacatctttgcctttgtggatacctgtcacttccctatccccactagggcatctgaaagtccatcacacccgggaaacctacccaagtctctctccctgaccacatgggaaacagcctttctgtttctcctgtggcatgtgtcatggctggcattctctgttactcgttctgatcctgtctcctctccccctctgatccgaccctcctggagaatgggatgctgtataatttcatttcccgtgtgtgtctagagccgggctttgcatgccatcgtccttcagtgaacagttgtgaaactgaacgaaattgccttcggaaaaccctttccggtccaactgtttctctatcagaaaatctcattaagacttaatcgctaacatcttcccatccccggggtcatgctgtaatccccagctgagagtgcgatccctgactgggaggaagtgagagtatcatttctttcccagaacccacacgcttcctgtgtatttcccaccacccaaaggtcaccacctggggtaaaattacatgcaacctcatgagacttgctgcccctctatcttccctcttttatttctgaagtcactgtagggaaaatgtactgattgcaaactgaaatagcagccactgggagctggactggtatggctgtcagccataccccccgggtttcacctgcttaatgagccggtagcccatgctttatccagtagagacctcactgtctcccattccagcccaccgttgcccacccttgcttatccacacctaccaagagccccttcccgagaactgctcttccaaagtgagattgtactcccaaccctcctctgtagccatccttgggtccagtgtttatttctttgtggccaggaaatctctcccttgctctgttctgcatagatgttgcctgtgttagaatttcagtagaactctgcagatttgaatggaagatttgagggctgcaagagctatcatcgttgatagcaagcatttagctaaggaaattaaattggaagtccttgcattctggctggattctgttactctttgggcagggaatgatttggtttcaaggagattccatcttcgtatctcctgctttcaagggaggaaagggggaaagaaagctgaacagagcctaatgaaggaattctgtatcgacacaactctgacatttgagatgttcaatgtaatcagcacaactggtagctttaggcattgatcactgtgctgaaatataaaattcagttggccatattctgttcatgaaaatgccttttcataattcactgcttccagaggtaccagcgataatttcttgactattttattctggagagctttaggtatggttaacaatgtgccatgtacagagaggcatgtatgcacaccataaagatcttaaatgcattttcagttcagtgtccttcttattaattattctagtcactttaatttattcagcctccgtattttatacattaaaatgagtgaaaatgataagaaatattaatggttgtaattattgactgtatatttgagattcatgtctaaatacacttaacttgggaagatttgacattctgtttcactgtgtgcattatttgcctgtttcatcttctatattctcctaaaccctctctctctctctgtcaaggggggaggcgaattactgcaagtagattatgaaatattgttgtacatgcacgtaaaaatatatcagtactggcacatctgtaatttactcataagtatgagattcatattagagatctatatatcatataagcaaaataatatccatcctgtactatattattttactaacatgatggctgaatttcaaatgaactgcaaaggtcatggttgctgttctattagagccatttaatctcatttgtctccccattactaacctcaactttattagttgctgcaactactgctgattttgaaccgagaaagggttcctctaactgatgtcatttcatgctttgaatttacaagtaagagaccctgatttaaaattattagggctcctgggaaaggagaacattaaaagtttgcagtggtcctctggtttcccataaggtgaagtttttagatggaagaaagatgggtcctgtttcacctatgacatattgcatacctttccaagcccttgtattccctcacctcttgcccctcttcaaactagtgatcacgtctacctttgagaaaactagtagctaaaatgaaacaaagctactttatgaaaagtccatgagaagcaatttaacctggttgaccatctccatcaatctgtcacctggagagaagctgttgacaccacatgacctctcctccaccatcacgctatgaagttatcacttgagtaagggctttctctttgatgctatacaattaaactgaaggaaggaaggctttcgctagtaggaaagcaactgcaaagagaggcttaaaccctatggaaacaccttcccctctcaggcacacacatgcaaattatctttaaccaaaagcgaatgggttccagtcgttcagcacacatcacatataagatattcctagggcaggaactttttttttaatgagtgagacccctgtagagttcatgccattgcataaaatattgcagccatttgcatttaatggtgatacaaatactgctttgaacactgggaacatcatttactgagagaaacaggagatagtcagtataaatctccaatgtaaaaaaaaaaaggattaagataaaaagtagtttaaactccaacactttctctgtattttttattatttctaataaacaagcctatagcttttgaaattttatcactaacttgagaggtgactgttttctgatgtttatacatcactcacttagtcatgaacttgtagtaacaatgccacatgctttatcaatagctggtgagttaattgggagggagggaaatgttttcttaaaaaactaccttttctccagaaaggataattttatgtgtgtgtaataagaatctagtatacctggtgtattaggtgcttaatatattgtaggcccttggtaaataattctgggataaatgaatgcctgccaatttatactgtcattatccctcccctccctgatttagtaatttcaggctcaagtagttgatcccaatgcttttgtgcaatgtgtggcttgtcttttgtcattgtttataagctccataagaacagagactgtctattcactgttttgtttctgtaaatatataaccatatattgtgtatatggatccttaagcatgaaggcttagaggagataatgaataacacttttatacagaaatcaaaccaagactttcatatcattatggaatcacatgcttttagcgtaattaaagttgttgcatatagaacaaataagactgcattttctttagctgttaacttggacttgccagatatccagacatgcttcacttttggtttgaattaacaggtgaaataatacagtgtgtgttttgttaaaattttattaaacgccgctcttaaaaattaagcaagaaaatgaaagaaagaaacaaaaacaattaaccaaagatcacccacaaagctcccaaactgttttgttctgggtgctaaggcactgtttgattttttttttcgtgcatattgatgtactctttccccgttaactgcttctagtctccctggacctccaaggctgcatcttcagggaataactcatcgcatctccattatgtgtcatgtagagacgctatgtaggtaagataacagagtctggctaaagggcacgtttggtgttatattccattagtttattgatttttttttaagtttctctaatgttctaatgagaatattttccactcaatcctgaaggagtccaaagctttttacgaacttcaggatagaacacacagggactgattccctaggctgccgaacagcagggtccttggaaagaccaaatggaaaattgcttttctatgaaccccaggtgcaagagttagggaacccctatctaattaagagctgggggagttctgatgcagtcactggggttggacccatcattacggtgaatgctaggctctggccaaacacctacagccccttcaagggtcaagaaagttcatggcaaaagatttgagtcacttcaggggatggtggaagtttctcccaagcctaccttggcgtctatgactccacctgaaaaatggcccaaaatggacaataaaggaatttggagggacaatggcatcaagtcaggacttcctctgtaggacacatatccaaagagccaacccactagagctccagccgcagttcttgcttgttttggctgtgtgaatttgggtaagtcacttagcttctctgagccttagctttcaactttgtagaatagttctgagcattaaaggagacagtatatgatgtataaagtggaattgatgaatggcaggttctcaataaaagttggcttgtggttatatcattatcatcactactactgtcatgatgtccagacatcaaggcagcagaatgtgtcctccatgtgttaacctggggcccagcctctatttggtgcctaatagttaaaagttggatgcttgttgagtaagtgagtgtatgagtcccttgtcgtctccctgccaaagggaacacttgatcagcataggagataactaacggcagtaactttgctctgagctcttgcttcttcatcaaaccgtgctttaaagacttccctgtgcagaggcagtatagaatgaggctcaggaactcaggctctgtaggctctctccactcacctctttatgtgtctgacaggatgccagtccaagcatccttttccttattgataaaaataggcatcatgataataatagtatctacctgataggatggtgaggacaacaaagtgagatcacgagagcctgacactaagaatcccctggagagctttgaaagcattactgatatccagaccctctccccaaagtcttggattcatttgttcaggaggcaaggttcctttgggcatcaatagtgtgaaaagccctccaagtgattctaatttagagcctttgcaagtcactagttaaggggtggtagggtggctgttgttaaatcatcctaactttttgtcttttcctgattatccctttctctgttggttcctttttcacatttatgggaaaagcaattatgtacctttttggaggtttcactatgttttccttttgctgggggtaccatttctgggaaatatgacacagagaaactttgtagtaagtgaaaggtaaatatagttatatatctatagatatggatctgtatattgaaatttaggaaatgagttatttctactgcagtaagccacattttcatgcatgcatagcctgccattttatggttgctgttgttaaatcattctaatattctgtcttttcctgattgcccatttctctattttttttttcatattaatgggaaaaccaatcatgtacttttttgaaagtttcactttgttttccttttgctgggtgtaccatttctggaaaatacggcactgaaaaattgcaataagtgaaaggtaaataactggatatatgtctatagatgtggatctatgtattaaaatttaggagatcagagttattcctactgcaatgagccacatttgcaggcatgcatagcaccccactttgtggggcacccattgctcctcattctgggtccagctttgattccctgtggctgctgcagtctctggctcatctctgcagctttgatagctgtctcaaatacaatctgcaatctatcaaggagggcgtggaggtgtcctgaataatcagcaggtgtcttggttatcaccaaggagagggcatcatgcccggcatgcatggatggcagaagagttactgcaaaggcagttgtaagctcaggaatccaattctttttctaagttagtgctgaaatgtggctgactcagatgtggggtgtcaggatcatagataggacaagagagaaaacttgtgttcttatttgaaagccacagcctgtgtggagaggcctgcagttcattgccactggacaagagagtaaaatttctgggacctccacttactctaggaagtgttagagggtgataggaaaggagtttgtgcagacttctgcagcctctgcaggtggaatgactgttctctcctctagtctcttagagtctgtccacaacctctgaatagcccttattccttggtgagtcactcagcaaatgagaaattaaatgctattgtgcatgctttatattatgtgtatttcttctctgttacattctaagccacttgatggcagagccgtgagttactttgctcaggatattcagcaccaggaaggtactaggcacacatccttagtacccaggaagcacaggggagttgaagatgctttgaaagacctgtttggcccttcaggtagacatgcatgggccctgagaagccccagaatttcgatgttctcaggaatcatcaggagactagaagacattgattctcaaccctggctgggtagcagggctccttggagagttttaactagtcttgatgcctggatcccagaagagaccaatttaaaccagtgtctctggatttggagccagagtacctacagtattgtagttccttaggtgctttgggttcaggcagggctgaggaccacagctccataataaaaggatggctgagctaaaaggggtgataagaggtagaaagaggctgggaacggtggctcacacctgtaatcccagcacagagaggccgaggcaggtggattacatgaggtcaggagttcgagaccagcctggctaacatggtgaaaccccatctctactaaaaatacaaaaattagctgggtgtggtggcacgtgcctgtaatcccagctgctcaagaggtaggctgaggcgggagaatcgcttgaacccagaaggcggaggttgtggtgagctgagattgcaccattgcactccagcctgggcaacaagagcaaaactcagtctcaaaatatatatatataaattaaaaaaaaaaaaaaaacaagtagaaggaaggagtgatacaactgaaaggagaaacaaaacacagaaagatcttggcggttttgttacatcttcagccccatcaaaccaacacccttcaagctagacactttgcttttagcattttgtcattgttaccctgtttcttactcacagtgatcttaaacaaaatgactaccctctttgtagcaaaggaaaggaagcttataaactgatgtgctaggctcctggactccagacctcaagcacttagccagtaaactgtgttccttcaaaaagacaaggtaaatatgaaggaaaaagggagtgaactggacagaagaaaaaacaaaattggtaaactcaaggaaagctgataggcactaaagcaaaaacaaatgagcagaattcatagttgttgagggcctccaagatcttatgagaaactcagaaggtgcaaagcagacccagtcatctccagcttacaacagatctgggatggctcacagtagtccagtgtcttgctcaaactcacaaagctaagtctctgagctagtttttctgtaagggccaaaagctaagtatgttagtctttgctgaccacgtagtctctgccacaagtattgaaatctggtattgtggcagaaagtggccacagatagataacatgcaaagaaataaatgtagttgtattacaataaaatttgatttatggacactggaatttgcatttcatgtaattttcaggtgtcatgcaatcttatttttctttggatttttctcaacttttttttttaaaaaaatgtaatcaaccattcttagctcttggctatatcaaaatagatagtggggcacatttggcccttaggctgtcatttgccagccctggtccaaactttaaagtacccagagggtaaaaagttgatgagaaagcatagaaaaaaattgatacatgactatttgagacatttacccccagtccaccttcccacagaaagatccatcaggccaagagtccaacactttccatcttccatgactcaatgccaccaagcagttatttgtagaatccatttgcggttttcaaaccataggctctggacttcaaagcaggccagtcccattctttttgtcttgaaatgagtataataagctcccagaccctttgttctagcaatatttattgaattactaataaagactagactctgttctgcgcactaagggtgcagtggttatcttagtctatccagttgccatagcaaagtgccatagacagggtggcttagacaacagaaatcttttctcttgcagatctggatactggaagtgagatcagggtagtaggatggtctagttatcatgtggtctcggtggcttatggatggtggccttctccctgtatcttcccttggcagagagaaagagagagagggagaggaaagaagtgggtgtggagggaagatgtcttttctttctttttctttatgttttcttttcttttctttcctttattcatttatttatttgtttatttatttgtttattttagatgtagtcttgctctgtcacccaggctggagtgcagtggcacgatctcagctcactgtaacctccgcctcccgtgttgaagcgattctcctgcctcagcctcccgagtagctaggattacaggcacccaccaccacgcctggctaatttttgtatttttagtagagacgagtcttcgccatattggccaggccggtctgaaactcctgacctcaggtgatccgcctgccttagcctcccagtgtgctgggattataggcgtgagccaccatgcctggccaggtgtcttttctgataaggacactaatcccatcaggagggattacctttgatatagtttggatatttgtccccactcaaatctcatgttgaaatataactcccaatgctggaggtggggcctggtaagagctgtttagatcatgggaatgggttcttccttgcttggtgctgtcttcacgacagtgagtgagttatgagatctggtgggtttttgttttttttttttttttttttttttttctgagagggagtcttgctgtgttgcccaggctggagtgcagtggcgctatcttggctcactgcaagctccgcctcccaggttcacgccattctcctgcctcagcctcccaagtagctgggactacaggcgctcgccaatacacctggctaattttttatattttttagtacagacggggtttcactgtgttacccaagatagtgtggatctcctgacctcgtgacccggccgcctcggcctcccaaagtgctgggattacaggtgtgagccaccgtgcccggccggtagagatgtggtgattttaaagtgtgtggcaccttcccccacgctctcgccctcttgctcctgctttggtcacgtgatgcttctgctctttcctcactttccgccatgacgaaagtcccctgaggcttcgctggaagcccagcagatgcctgcgccatgtttgctataaagccagtggaactgtgagtcaattaaacctcttttgtttataaattactcagtctctggtatttctttacagcaatgcaagaacaacctattacacctcatgccctcatctaaatctaatcacctcaccaaagctctatctctgaataccatcgcgttggaggttagggcttccgcatatgaatttggagggcacacttcactccgtaacaatggtatacaaaataatgaggtttctgtgttcatgagcttacattctttatatttgacaataaaaaagtaagcaaaaagtaagaatttttagctaatgttaaatgctacaaagggaaaaaaaataagaaaacatgtaccgattacagagatgaactgggacaggaattacaagtttggaaactgttttcagggaaggcctgtttgagcaggtgacttaggactgggggtgagtggtgtggaagcactcctggaggttgctggggggagactggaagactgagcaatagggagagagaagatcatgttcaaaagggccactgagaccaaaaagctccccaaaacaaaaacaaggttcaaaagggtgagccagcggggtagacaggaggccagcatacctgaggagagtcgaagtgggggacagtagctcccactgtggagagtttgagtgttacctattaaatgcaatggggagctgggcacagtgtggcttatgcactttgggaggccgaggtaggcaggttgcttgaggtcaggtgtttgagaccagcctggccaacatggcaaaaccctgtctctactaaaaatacaaaaatttagctgggcacggtggctcatgcctgtaatgcgagcactttcggaggccaaagggggcggatcacttgaggtcggcagttggagaccagcctgggcaacatggcaaaaccccgtctctactaaaaatataaaaaattagtcagatgtggtggtgtgcacctgcaatcccagttacttgagaggctgaggcaagagaatcacttgaacctagtaggtggaggttgcagcgagccaaggttgcactactgcattccagcctgggcaacagagtgagactctatctcgacaaaaaatttaaaaaaataataaaataaaatgggaagccgagcacgatggctcatgtctgtaatcgtagtactttgggaggctgaggtgggcggatcacttgaggtcaggagttcgagaccagcctggccaacatggcaaaaccccatctttactaaaaatacaaaaaattaactggttgtgatagtgcgtgcctgtagtcccagctacttgggaggctgaggtgggagaatttctggaacctgggaggcggaggctgcagtgacctgagattgtgccactgcactccagccggggcaacagagtgagaccctgtctcaaaaattaattaattaaaccttcaatgaggaggttttgttgagtcagaagcacttcagtacagtcatgcagcacttaatggcaggggtaccgctctgagaaacaaatcgttaggcaatcttgtcattgtgcaaacatcagagtgtactcacacaaacccagatgctgtagcctacgacacatctaggctaggtgatctagcttattgcatctaggctacaaagctagcaggttagtgtgctgaatatggtaggcatgtgtaacatcatggccagtgtccctgcacctcaatatagctaaccatagaaaaggtactgtaaaaatactgcattaacgtcttatgggactgctgtcctgtaggcagcctgtagttactgaactgaaatgtggttaagctgtgtaggactgtgtttgcattttcaaaatattttgggtgctattcagggaacggacagtagggggcaaaagtggaagtggagaaaccaaggaacaggctgctgaagaagtccaggcagccttggaggactcgctctcactcttactggttttcgatgcctgagttacttgctctctgggagaaggaagcaggtcgttcctctgcccaaattgctgctactcaggagtgcctgacactcctttccaaagatgctctgcggtaatatgttctaatgaggagtttgaattgccaattgacttgctctttgcagctaataaagaacagattatgcgctggatggtttgcagttggtggccaagttgtcttgtgattattgtaagttcttttagttgagcttgtgtaactgtgagtcaatcctgcccatgttttatttggaaattagtactagagcctccttgggactagcctttttctcacccaaaggcaaaagaatccatctcggctgggcacagtggctcacgcctgtaatcacagcactttgggaggccgaggtgggtggggcggatcacgaggtcaggagttcgataccagtttcaccaacatggtgaaaccccatctctactaaaaatacaaaaattagccaagcgtggtggcaaatgcctgcaatcccagctactcaggagcctgaggcaggagaaccgcttgaaccctgaaggcagagtttgcagtgagccgagatcacgccagtgcactccagcttgggcgacagagtgagactccatcttccatctcaaaaaaaaaaaaaaaaaaaaaaaaaaagaatcagcctctggatcacattaaccctcacagcccatagtccttcgtcttcctctgaaaaaatatgaaatattaaagattcttaaaccaatgagcagtttccggttattccagaatatacagcacgttggtgacttgttccacattttctttttctcttctcagtgcttcctgctagacatagacacatacacacacctacaccccttttaacccattttaaataattctgtttagaaaagcaacatatgatcatttaaaaatattgagaaacacatacaaaagcaaaaatcatccattagctgctcatcacccccaaataatcactttttaaaaacattttgatatttctctttttggggtctctgtgtgtgtgtatgtgtgtttgtgggacagagagagagagaggcagacagaggaaaaaagcttacagtatttgactgatagtgaatttttagaatttatcgtataattttttacttggtattaaaatgtgaacattttaccatgccatgaatcattttgggaaattacatgtaatgattccataatgttctgttgtaccaaaagttattacctctgttgttattgaagaaattttttatctttctcccttactattattaagaataatgtcacagagaattttcttatactcaagtctttgtttacatttttgaatatttccttggactaaatgctaaaaagtattgtgtcagggtcggaagatatgagcatctttatactttgtgaatagattttatgttgctttttgaactggttgtgcccctgcacatcccataaccatagcgtattagcataccgtttaatctagtcattaccaacattatttggtattattacatactttattaatttgataggtaaaaattggtattgccctgtttaaaccttccccttttcatcttgtctgtttcgtaatgccaagagtaaacacatatcatgctcttaacacaatgtgaaatactgtggaaagtagatactactgtcctcattttacaaattgagaagctaatacttctcgttgagaggtggagctaagatgggaacccagtgtaggcaatgggaaccttgagtctgagccttagccagggctctgttccgcccccaggcaggagcaggaacctgagaggaccttctcagttaggtgtgaaataggaaagcagcctcattgaagtaattcacactaacatgtgaatgacctggaagcatctgtctggtttttatgaaaaaccaaacagaattacttgttatttcagataagcttctcctttgtggatggaaatgtaagaagtttaacgcaagtaaaaaaaacatctaacaatgataaaggaagataccatcgggcagattcagaccttatggaaatgtaagaagtttaacgcatgtaagaacacctaacaatgataagggaaggtaccattgggcagtttcagaccttcttgcaatgcagtggtggctcactgctggcccacagactagaatcatatttattcctatgagataaaagaaaataggtcttaaaattcagtgtttaaaatactaaatcagttgctattagacaaacctctactattctaccttctctttaaaaatggaagctctggaaacattcactactgtttctttcagtaattgactgcatctgattaatcccactgatgcttcaccttgcatctgttagctggctagctctcttcttccttccctatcaactttccccgctttctccctttctgagccaactctctaaaacttttctttttgataagaatattatattttaatgaaaatcctttctgtcatggagaatcccctttccatcatggttaggaatggagacttaggggttacggtggggctgggtgctgagtcatttggaagacacacatgtgcaagttggggcctgtgtctttattagccctgcttaaattgctgggtaatttaagcctctcttattttgctgcattgcctcacagttctaaaggagacctgaaatagagtgtatcacattgtgcacatttttgaaggatcatgagagcagcctaaatataaaattcacgtccatattcttagtgtccttttcccctaaatggagacgggatgcacttgagcattctgtcccatgcttgcctttgtctacacgtgtttcctaatgtttgatctctgtcctttttgtatgtgagaacattcacaggcatcttcctagctgcaaaaagacgggcctgggttgcaacaactggatctttgttatttcttggggggagctcgtatcaaactctccccaatccatgtagtgatttttttctacatctaaaaatgatcctttaaagtttcaatgatgccttggtgacccaggaccactgttgtaatttttgccagtttctttgtatcacttggttgatcttgtattaaatgtctaattgatttgtttttttaaagatacgtgcatgttagtataataactagaagctcgatgttatgagttgaagcataattatgcaagcaacttaatactaaacttagaagatacgtgactactaaccaagaccatctgatgtaccattgatggctcaaatgccagatgtcgggaaacagtgatttaaaaggaaatatttcatgggggtcagcataaagtcggtcctgcttctagaaagccacagtagttctctgtatccatagctaagggtctcttaggctcttattgtaaatgtctgggtttcactcaggaaaaaaaaaaaatctcaaagctatggccaaggcagaggcttcctcacagcccatcccctgtgcatatcgattagttgacatccatgagtgccccagtcctgctggaaatatcccctcaggcttgcttttctgtggtatcaccacctattcccctcttgttactcggacctctttgaagtcatcatagtgtttttgggaatagagaataccactttgcagagagagtgatagcggcttgtgatcatatcctcttcatatccccattgtcggcgtttgtaagaccccaaatgctcctgaaaacttgatttctaatggttatgcaatatttaaatgttaatagattactctttgcttgaccatttccctattttattttttttgagaaagagtctcgctctgtcatccagagctggagtgcattggtatcacctcggctcactgcaacctccacctccctggttcaagtgattgtcctgcctcggcctcccaagtagctgggattacaggcgcccaccactacacccagctagtttttgtatttttagtagagactgtgttccgccatgttggccaggttgggcttgaattcctgacctcagtgatccacctgcctcagtatcccaaaaggctggaattacaggcatcagccaccatgcctggcacccgtttccctagtttagacatatatgttgcttcttattctgcatcattcattcattcatcaaatatttataggcaactatcacttgccaggttgtagagaggacaggaaagcagtgctgagcagccaggcctctggatccttcttctccatcaatctgtgaatttttacttatatctgagaagggggagggatggaaggagggaaacaagggagaggagagaggaagggaggaaacagacgcagctgagagctcctgaagctcctgaaacctctgaggagcattctcttgctttgtattcttttcacagaaccagtgactcttgttttcttttaaaatcctctcctccctcccctccctcccttcccttcttcccttccgttcttcccttccttccctcctttcttccttccctcctttcttcctccctcccctccctccttcctccctcacttccttccctgctttcttccttttccttccttctttccttccgtccctccctctctcccttccttcctcccttcctttctgccttccttccttttctttccttcccctcccttccctccctccttccctccctccttccatccttccgctctccctccctccctttcctccttccctctctccctccctttcctccttccctgcttccttctttctccttccttctttcctctctccctcccttccttcctcccttccttcctccctcccttccttccttccttccttccttccttccttccttccttccttccttccttccttcctccctttctctttttctcatctatgagccagaatgttacgctaagttttggaaacagcactctctgctgtgtctttaggatgcttgtttcctgcatgctgaccagacctcctgttggactgatattctggataatggcttggtgcctttctagcttctaatctaaacaagaattatttcattttagattctctctgctgcatcaagggtccctggaatttgatgatgacttaagtggaaatcccagctttagcatatataagctcagtaccatagaccaagtgggttaacctctttgtgccttcattttttcaatggaaaagttgcaaacaagatacttacctcccaggattttcctgacaatgaatgagaaaatgtaagagaaactgcctttcgaattgggaagctctattctgatgaaagatggaccttatttttaaatacaggacgtttagtaattttatctaaattccccattcatcagaatacagtggagaagatatttgccatacccatttcattgtgttgttcataaacttgtttatttttccagggctggattggtttgcctttctctctttctgtctgctactgcataatttcattatctgccatacgtaaatgtattatgtaattctctcagttgtcattgattgcttctgtttttctgtagtattactggtctataatactttttattaaatccccaaggatagttcctgaactgtggttgaaggaccctcctttccactaagtaaaatacaacacttagatatttgaaatgacacaaagtactagagaaaacataagtgtggaattttcccactggctttatgaaatccaggaaaccaattgagatatttgtttatgatgcctttgtctatcctggaggtttctctctgcgttctttcaatggcagtcacagcatcaacaaattatataaaattagctaatgtttattgagtgcttactatgttccgagtaatgttaggaactgcttgcattgtcatttaatcgtcacaacagcctcataaaggaggtacgctttgttatccccattttattcttgagagaactgaaattcagaaagtttaactgctttgctcagagatacacaataaagaagagatgaaactgtaaagcacacccctctcacacacacaccacacacacatacacaactttatgcaagcttagcaaagtcagtttccttcttagcttggagaatacatacatatgttgaatgcctgagagtttgggacttctctgctctgtacttgcttctgacactaaccttaaactaatcacttctctctggaactaggtctacttatgggccacgtttgaagggttggatgaggtcattagtttttatttatttatttatttatttatttgagatagagcattaggttttttttactttttattttatttttttgaggcaaggtctcatcctgtcacccaagctgcagtgcagtaagacaatcttagctcacatcaatctctgccttccaggttccagtgattctcatggctcagcctcctgagtatctggaattacaggtgtgtgccaccacacctggctgatttttatatttttagtagagagtggattttgccatgttagccaggctgtctcgagctcttggcctgaagtgacctgcctgcctcggcctcccaaagtgctggaattagaggtgtgagtcactgcacctgcccaaaagcattagcttctaattgacctcatgatgttcaagaatctgagcaggtggtcgaagggtggtggagaggataggaaggcagtgctgagcgggcagggttctggatccttcttgtccatctgtctctgagcttttgcttatatctgagagggatagagggagggaaagagagaaagaagggatagagggagagaggaagggagaaaacagacaatcgacatcacatgctacactactaactcattcaaaaatagcattgtgccattgctatttcccatgtatgtcattagatattccatgaaaacttgatttctaatcgttatataatattcaaatgtgttaataggttaccctctgcttaaccatttccctgttttagacatgtgtgttgcttctgatacttcatcattcattcatttatcaaatatttatcagcaatgatgattctccagacattaacataagtaagtagggtgtggattttcttatatataaatttttgacatgcctgcatatatgtgcttccataactatatagaatttggtatttttgctcttgctgctaattgctggacttctttagtgaaagattacctgttctggaaagcctgctaatttagatggtaggttggattgaaatctgtgcaaatgatgagcttatctgtttcggggaacataattggagttctggacacactctctcccaggattataggtatgagattaataggcattgttttgatggcatatgccacaagcatcaaaatatccactttgtgaccttcaggcttaaagggatcatcttgaaggtatagctttacatgttgcctagtttagaggtagatgaggctgtagataatgtccactccaacctgtgcagaaggatctgagaggcagccccaggggttgctgtaagacttggtgttgctgactccccttagaagtaatctccaaacaccaccaccaccaccacgaagtgtgtcatcatataaactgaagatagctgagattacacactgcctaaatttcactcagaaaaacatgatagagatcatttctgattgaaaaggcaataaagaaactcctaaacatacctctttgtccataaatggaaaccagacaaatcaggcttgtagatttaaagagaccctgcaaggtggcgattctgaaataccccttggaaggaccatgccaagtctgaagtgaagctgcagagtgaagcagtatccagagactgagctatttctggctgcagactttgtgtcatgaaatggtgataatttccccacgccccataatgttcctctccttcctgatggctctataagtttgagtgatgtcagtctgtttggaggcagctaggtttgcttgtgtcttaggacagatgtccagaaaaaacaaggctagaccctgaagagcctggacatccattagaatgacaaaagactctgtggatacaaaataccattagtttttcttccttcctctatattctctctttttatctccttccctgatagcaagcaaagggtagggaaatctaagtaggaggcttctatccttgactgatttttttttaaatttttctgcctcctaggggatcacttaattcattttatgcctctggaagagaccagaatttcctcactcctccaaattcctgggcaggttacctctcccaacctcagttcatcattattctgcactgagttatgtaatgatttgatcgtgttgaggagtaattcacctttgttcccacctacgttaagactgattacaaatcctcataaaatactgattatgctaccaaaaatgttcttaaggatagtctgttaggaaggaggtaatgctgctgctcagaagtgtgggcttctgtctaattatgtgtaaattatctgagtggaatctcaaatgtttagtgataaacagtttgatgcgtcccagcaaagtatctagtttgtgaggcaatataatcaaaagcagcttatgtgcagcaaatcgtagatggtataactttgcgtctttttcaagttatttttacagaaagaaatgagaatttgtctgcagccctttaagaatagcaaacgttgtattttgcattttttaaagaaagataattgatcctttgactatactgctgttctgttctcagaagaaacattaaaaagttggatttcttaagaaatgcaattaaccgacttttatttaatgattttttttcacgttattcatcctggaggaatggtttctgttggttattatcaaagatgaggatggattttcagaagcaaaatatcatgatattctactgcaatgcatctgtggttactcagggaagatccaatgtggtttgtatgtagatatctccttctttagaaaacctttcctgaattgcctacctccatctcccacccatctccagctggaatgttgtacattctctgtgccaccagaagaaagctattctaataatcaaagcgaataggacaccatttaattgggatgaagccacaattgttagtgtagctagtggtaattgaacctagatgttcataatctaggatcctaaactagatgttctgataatctagatcttcataaaatacaggtatttaagtctgaaagctcattatttcttagtctcagtggtagggttccttaaaggcccaagaagcttgagagaagtctaccagggcggatacccatcgaaaaatcaaagccaaggacttctataggcacagaatggtcaagatatttattcagcatagcatgaggaagtttagtccagtatagaaaacaggaatatcagttaaaatgaaattagcatattagttaacataagaattcccacgtcagtgtttgagaacactttgcagctcttctagagacattcttattacagaagaagatgactaactcagaagaaaaagggtatgaaagtctagtaggagaaaatgattagcaaaaaaaaaaaaaaggtactaagacattaatattttattgaaaagaggcaagaattctgtcagttccttattggtggtcaatgcagaataatgctagcattgcctatcattcagttgattccgtaggcggctaaattggttgcttaatgaatccatagtggtatttggctccgcttggtttccaaaattgtaaggtaaattctgtgcacgtggttttaagttggaaatggttgatatggttatacttggtgtatgcattcaacaaattaaccagttgcaaatgtgtgcctattcacaaaccccttgattgaattgcaagtataccagctaattagacatgtgttccgtaatgcttaaagagagatcaaacctccttcagtgtctctagatggtgaagtcttaaatttacccaagatcaaaatatctacataaagattcctatgtatatctgacatgtgcaagccagagggtgttggacattttgaaggccaaccatttagatgattgactaaatatatttactttcatcatacagatctgtccaatattaccagcataccttttaagaaagtgtattcatccttttagagttcattaaaatttatcatgactgtctgtgggatgcatttatttcatattgacttctgtttgtatcctttcctatcctacattctctataaccagtctttttgcaagtctgcaattcatatcaaaaagtctgaaggaattttatttttatttccttttcagtgaaaacatattacaaattgccaactcatgatgtattcagtttgaacttaaaatatcatttgtttaaaaaatgcaataaaacctgatatgtacactgatattcattctgaagattaaagctgccaatgaattatggagctgggccaaggctgtcttgttctcagcctaaatttatcttgtcgaaagggaattattctgaccggggctagagagtgaagatagttaaaatttgattgttcgattgctttcttctggcttttttttccttcttaaaaaatatttgattatatttctcttaagagctggattttaaaatctaaaaactgatgacggatggataaaaagtcctattttatctaattctaaaagtgacgtaggtttctggagactcttttttttttttaatgtacattttctctttccttttctttctttcttttttttttaaacatggatctttggccatgggggaccccatgctgagtgcctaccctctctgacttacacagaggaagcttcagtgtaatagaaataaatgctgcattttctctgtttataacatgtcacttgggcaaagtggtacagtgtctctttggtaaagctgaaatgcggatttctcagaaatgtcttgttttcagttaatgatattttctgcttttcaccaggtggtctctttggggctttgctcttgaattcatttctctgtgcgtaagccaggctttctgttactcgtttattcagccggcatttactgagtcctcaccacactcaggcctgagcgcagcgtccaggttgcagtggccacggaaaccagccctgtcctattggtgcttgctggctttggggtaaagtgacaggctgatactatattatagccagggccacgttagacatcaaaataaaatgttctgggaatagagaggagggatggcctggcatggaggtgagctgggggaatcaggctatctatggtcacatcattctatgaactagcagaccaggcataatgggcgacgtaagctcgccctggtgttgcctgacctgaatgagtgcttctctggaaagagctcatagttcctctttctcttatgtgaaatcccacaaggaaaggcaacttccagaaatggccaagctttctatccctaaagagccagccctcaaggactcatgaaggctgaaagggaaattgatcattggctcattatggtcctgatcaggtatgacctttgagaaaccagtgggcctggtaacaatagggcagccaagttggccatatcagcagatgttgcatttgctgactccatggccagcgccacatcacctgctctgaaggtgtttggttcccgctgcgattggatctgtattcaaaacagattgtgcctgctatggaaagagagccagcttctgaatcctggctgagtttgacttcgttgaccacagagtcttggttctttgcaaacgcaaaggaaaacacgatgtacaccttgactaaattcagctgttttcctcatccattcagccttgccttcattgcaaaatgagcaagcttgtgtttcagagggcttaggtcacttccccagcttcacttagatctgggtgttctgccttccagaatagagtccttcttctccctccatagaccctaagactattaacagtaggtcatccccaacctgttggttaagaaagacatgcacagtatctgcacaatgtccaagggatccccaggatcacctcacctttgtccaaagagaataataaggtgttggtagataagagggaggcccatgtgcctctgccattaggtcctgtgacagggagtccacatggagatcatcatgtgataaagaccactagggctgtagtccagggacaagcttgagtgacatctcagtggggccgctaccttcggagagctccgcacataaggacagagtggctggggcagtcaactggcatcctagaacatatttctcaagaggggccctgctgacgttttggaccagattgatagttcattgatatgagttttatccattgtaggatgtttggcaaaatccctggcctttccccatgagacactagtaacaccctttcctctgggagtcaaaacattgtccagtatcccctggggtgcaaaatcacccactgcttgagaaccgctatcctatggccatatttgtactcactaaagaaagggtacataatggcagctactctgggcctcttgaatcaattgcatgtgattccctacctacctccctccctccctccctccctccctccctccctccttccttccttccttccttccttccttccgagacagagtgagtctccttcacccaggctgaagtgcagtggcacagtcttggctcactgcaacctctgcctcctgggttcaagcaactctcctgcctcagcctcctgaatagctgggattacaggtgtgtgccaccacacctggctaatttttatatttttagtagagatggggcttcactgtgttggccaagctggtctcagactcctgaacttaagtgatctgcctgtcccagcctcccacagtgttgggactacaggcgtgagccaccgtgcccagtgcaattgcatgtgtatttaatgagcttctgcttggggggtagtttagcatacatttggaggcagatgggctgcttcccttattgtatgagagccaggtgactttgtgcaaaacacttgcctgctttgtactttagtcctctcttctataaaacacagatagttctaacactgtatatctctcccaagtttgtagtgaaaaaggattgcacacatacacacacaaagagaccattatgtaagtgttaactactattcttattagcattgtctgggcacaatatctggtgttggaagtcagagaaaatacacagcatgttcttttcttcatggggttctagtctagatgagaagacagtgtccagccactgagagcaatatgcaaatcagtcatcataaactgagtgactgttaggagagagtctattgagggaaacgtgggttatttatagtttgcttgagtttgaatccaggagacaatcttgacttcctctctgcagaccaaaataatctttctttctctcttttcctccctgccttcctttcttttcttttccttttatttttgttttcttttcctagaaaaggtcttactctgtcacccaggatggacaggaggtcagtggcacaattatagctcactgcaacctctacctcctgggctccagcaatcctcccacctcagcgtccggagtagctgggaccacaggcgcgtgccatcacgcctggcaatttttttttgtattttttgtagagacagggtttctatttgttgcccaagctcaactcctgagctcaggtgatccacccacttcagcctcccagagtgctgggattacaggtgtgagccactgtacctggccgactaaagcgatgtctgaaaagggaggacagaatccaccactcaccgccccaaacccattttctttgcagcgtttgctcagactaacagtcagaggaacaagtaaatggcatttgcaaaggggatttcatttattcctggatgccacagttacttgttcacccccaactcattgcaaggcacagggtcttaggaattctttaattgtaaggaacagaaactcaccctgtatgaagatatctcattataagaatcaaaagatatttcacaaaactcagttgcatgaaatatggggaaatacatggatattagaagttatcaggtggattttctgctgccttttgctcttgcaccctctccctggagccttctgctctctgttctctggttgattaagcttttttttttcctgttatcgttcttttaaaaaatttttccataggttattgggggaacaggtggtgtttgatttcataagttcttcagtggtgatttgtgagatttgggtgcacccatcacctgagcagtatacactgcacccagtttgtaggcttttacccctcacctccttcccaccctttctccctgagtccccaaagtccactgtgtcattcttatgcctttgcattctcatagcttagctcccacttatgagtgagaacatatgatgtttggttttccattcctgagttacttcacttagaataatagtctccaatcgcatccaggttgctgcaactgcgattaattcattacttttttatggttgagtagtccatcatgtgtgtgtgtttgtgtatctgtgtgtgtgtatctcacagtttcttcaatgcactcattggtttatggatgggttggttccacatttttgcaattgtgaattgtgctgctataaatatgcatgtgcaggtatcttttttgtataacgactttttttcctctgggtagatacccagtagtgggattgttggatcaaatggtagttctacatttaggtctttaaggaatctccacatgattttccatagtggtgggttaagcattttgactttgtgtgcctctctctgcttgtctctctctgttcgttcatcccctagtgcttggtccagctttcagttttccatggccttcctccctggtcccccaatctgcctctgcagtctctatactccaatccagcattcctgacagggagaagatctcattgaaccagcatggatcagtgtccaccatgagttcccacagttggaaagatttaggggagctcactaggtagatgatggtgcctcttccgtggtggaaaggagtatgaatttgctaagaaaatcgtatgggtggaggaaattggttgacacttccataacacctcccctctgtgttggccagggaaacacccttgacattctgtatctccatcccctagatcgcctctccctaaacaccactcagcctcaccgtcctcagaagctgtatccttactcagttttctttaattggcatcttctaaaataagactctcatattgttgcttcttagggtcacccagagcttgccagaagtgagaaaggatctcttctggacttgatctagatcatgtcatcagatcattgcatcaaagtcaggtttactgaggcataatttacacacggtaaaatgtactcattttagcacacagttcttcaagtttcaataagtgcatacagtgatgtaataaccaccagcgtccgcatgatttggagcatattcgtcattccaaaaacttgcctagggcctagttatagttagtccccagctctagatcctgggaattggcagtctcttttctgtctctacagtgttggtgtctccagaatgtcctacaaatggaatcagaagtacgtagcctttaggcctgactatctctgtgtaatggatttgagattcatccaggtagttgcatctatcaacagttccttcttcccttttattgctgagtagcattctgtggtacagatgcactatagtttattcactagttgaagggcggttgtgttgtttccagtttttgctgattatgaaacagttgctgtaagcatttatgtacaggtaattctgtataacaattcttagttctcctgggtaaattcctaggagtggtgttgctggattgagaagtatgtttatgtttaactttattcattcatttaagatatagactcctgctctgtatcccaggctgtagtacggtggcactatcacagctcactgcagccttgaaatcttgggcacaagcagtcctcccacctcagcctcctgagtagctgggaccacaggcactcaccaccacgcctggttaattttttaacttcttgtagagatgaggtcctgctatattgtccagattgatctcgatctcctggcctcaagcagtcctcccaccttagcctcccacagtgctaggatgacaggcataagccaccactcctggccctttttaacttcataaagatgttttttaagagaggcagaggacagagtggtagtttcggtgtttaatcctggatctgatacttcctagctctgcgacctcacggtttatctgtgccttactggattgcagcagaattaatggcaaaataataactctgcacaagttcagggcagtcactggctgagtgttagagctttaagatggcccctcatcttttggccactgccttcttgtactggatgttccttctttattgcctgagcatgcacactctttcttacatccttgccacacactgtttccttttctggaacattttcccacccacctttctcctcgccaacgcctcatccctccgttgcccaatggaatgccgcctcttcagaaaagccttccctcaccctcagtctcaatccagccctttgctatctatagattccttacttttttttttttttttttttttttttttttagcaacctgttcttatcctttatagcatttaccacaatgggcctcagaaaattaactgtataatttgatttttaattggaatttttattgagataattgcagattcacatgcagctgtaaggaataatacagagagttccaatgtaccctttacacagttttccccaatggtaacatttggcaaaattaaagtacagtgatcacatctaggatattgatgttggtacaacccagtgattttattcaaatttccccaatgttacttgcattaattgtgtgtgtgtgtgtgtgtgtgtgtgtttgcagtggtggtagttttatctggttttgtagaattttaccgcacatgtaggtctgtgcatccaacaccacagtcaggataacaaacatttccatcaccactggatcccttctgtttttctttttacaaccacccccgcccccactcccaattcctaatttctggcaaacactaattttctctctatttataagcttggacatttcaagaaatggacccatatagtacctgacttttaggcattgacattttttgatcaacgtaattccctggagactcattgaaactgctgtgtgtataaataacttattccttttcattgctgtgtagtattccatggtatggatgtaccacagtttgtttaaccattcatctattgatggacatctggactaactcctggatttagctcttataaataaaactgttacaaatcttcaagtgcagggttttgtgtgaacacaagattccatttctctgagataagggctcaagaaagaacatgctgggacatgatttttaagagaaactgattgatttttaaactgagtctctgctgatagacttttagttccatccgggtaagtagactgagttttgtttgtttgtctgcttgtttgtatctttaatcagcatactgggaacactgtacaattcttagaacataatttaccactctataaatatttatagatgatttaaataaggaacgaatgagtgaatgcatgaataccactgctggcatagggattaaatgaaataatttatgtaaatcatgttcagaatgtctagcatggagtaagctctaataggtaaacacttgtagcacaatcgccattgtaagatatgattttggttgaaggtgacatgaggaaatttcatatccttccaccttcagcatcatacaaacatcatgtggctttgcaggatcccaagggtctaggttcttgccactttatttctttaaataaaagcctatcttgtgaaaatgctcaaaagtgtcagagtgggaatttgggtttcatactttgatactttcttatttttttttttttttttttgagatggagtcttgctctgtcacctaggctggagtacagtgatgccatctcagctcactgcagcctcccctgccaggttcaagcaactttccctgcctcagcctcctgaatagctggaatttcaggagcacaccaccaggactggctaatttttttttttttttttttttttttgagacagagtcttactctgtcacccaggatggagtgcagtggcgagatctcgggtcactgcaagctccgcctcctgggtacccaccattctcccgcctcagcctcccgagtagctgggactacaggtccctgccaccatgcctggctaattttgtttttgtatttttagtagagacagggtttagccatgttggccaggctggtctcaaactcctgacctcagatgatccacccgcctcagcctcccagagtgctgggattacaggcatgagtcaccatgcctggccctgggcttcaaactttaaagaagatactgcttaaataggtcagggtgaagctacataaccacttgcctcattgaacatgaacgcaggcaatgcgtgatagaagctgtaggagtgtgaggatgtgtggcacaaaagaggttaactttgttccaagatcattatggtcccagagtgtgacataaatattggtgaagccaatggagttagcacagtacttaatagagagagaagattagtgattctcatttgcctgaggaaagtgcaggtcttgataatgtcttgatctatgtacaaagagctagtaaagacaagcagtcctcataataaaaatagaaatgaggttttcccgacaaagatgccaccagaatgatgagctgtcacacaggacctggagagacaagaaagaaacttctttggtgactataattaggattccatggagagcagcagtgtgcaggaactatgccagggtgctctctttctctttctagaatcaccatcaaacttgctctaaaggaccaggacagcgagtaggtgcaagctgatccttggtggaccaagcctgtattccccacaggccatggtgaggctctgacctggggtataataggcaagaagtgttttcagtctgtgacttgggctacttaaatggaagaagataaaaccttttatttttccttataatgaaagtacttcacgctcattattaaaaacttggattgattgacaattttgaaaaatgataaaagtcgcctctcaacaccacatttgggtgtttcctcaaagctttgaaaatatctatgtagatctatatgtttagatttagaaagagataaatttagaagtggagaacacaaattagtttatgatagattttacatatatggggtattacccaataattatggatttgcatattaccttcccccacccatttcgtgtgcatttttctgcttcttaagctgtttttccctcggtgtattttcaaaatacacatagtttgtgaggatctagcccaaatgaaatgagtgatgtgtgactggctgttgaacgaaaaatccaaaccaatctcgtgtgtatttgctggctgagatctgttttcctcatgttctgtagaagggaaggagtaacatggtctcctttagatgctggatcaaggtctgagatttttctaccttcaccctggtttccatataacagggaaatcctagagtggtttaagatacccacaagcaccctggggaagcggcacctacctcaaccatagtttgtgatcctgtaattcaatttaatttctggagaaagaatccactctcagagaactctcacatcaattgttcaactttcagacattctacttggaaatccatttaaggaatgcatcatacaataaagtagaagattcaaggtgagaaaatcacactcatctgagttagggcctcagggtgtacatttaaataagttatttatcttccctcattctcagcttccttacctgtgaaatgggaggagtcacatcaccttgcttatcagatttctgggaagatgaaataagataatgaatgtaaaacccttggcatagtgtctacacacagtaaatgctaagtaattcttaactgtgctattactggccggagagcagtggctcacacctataaccccagtactttgggaggctgagctgggcagatcacttgaggtcaggagttcgagaccagcctggccaacatggtgaaatgccatctctactaaaaatactaaaattagccaggcatgatggcacatgccaataatcccggctacattggaggctgaggcaggagaatcacttgaacccaggggatggaggttacagtgagctgagagggcaccactgcactccagcctgcgcgataaagcaaggctccatctcaaaaactttgttgttactttttacagtatttcttggacttgtgtgtgcttcttgataggacattggctatgcaggggaacaacattggaatcgtttgtctggtgagaggcaggggttggagaaaagaaagtgacagcctgctgagaatctgagtgatattagaggaagtatgggcaccctggaggttagtgttttcactaaaaagatcataaattattaacatccaacagagttacccagaagaacactcatgccagatcctgcctgctgtatcagagagcctccttagagatgtctgtggctgagttacaaagaagaaaaagcagtcagggtgatgatgggtattacatttgcttccttagtcaaacactagagttgagagagaaagcaagattggaagtagcaatgggctctccttagaaagattaaagagatggctccctttgtttctagcctaagagaacagggctggctgtctttcccacaaaggtcaatgtacattgccttacttttgtgtttacaatcaacagtagccagattatcattaccgataccaacattaccaccaccattatcatcatcaccatcaccatcatcattaccatcatcatcagcaagagcatcactgtcaccaccattatgattatcatcatcgttattacagtcaccttcatcgtcatcatcaccattatcaccatcagcatcaatatgataatgatgatcatcatgattatcagtgccatcattactaccatcactttcatcatagtcatcaccatcatcatcaccatgatcatgatcatcatcagcatcaccacccccaccatcatcattatcacaattatccttgaagctgatatgtgttgtgcacttcctaggtgctaaggggttgcaccaagaaatttagtgtattagtccatgctatcaaatttagtcttgtgagataaaaatattagtgcttgtctcacttataaataaggatccaagactcaggaagttttaaataacttgccaaaagccactcagctagtatgctgtagttcaaagattcagaaccaggaggtctgcctccctagtccttatcatccatttcgttatcaagaaggcaggacaaggttaggataaactctgtggccccagaataagctcttttaattcttattatttttcttcataggagagtaaacctataatctgtgcttcccagggttacatggcacaccactgtttctcagatacctacgtacatttacaccggtagaaaccattttagaaataaatgttacagaaaattccatctataagagagataaaaggagcaggataaaagatgcattttatgacttcaaatgtgaagcatgtatcgtaaaggcaattagtgagaaaatgaggctattttgatgaacaccaatatttgaaattgggagtatggatagataatattgttttcaattaggcttataatccaattcatttcagtcttttaatttgttgcctgctattgagaagatgctggttcacacactgatactgagatgcagaaggtaattttttaaccaggtgaccttaaaatatctcattaatctggaatgtaagctccatgtcctttcgtagttgagcactgtatctccaaggccagcaccatgcttcgcacagacactattttcaaaaggtagctgacgattgaataaatgaattaaccaactagtaaattaaatgaatctcagaaacatgaaaatggaagaggactaatattttcattttcaaatttgctcattcactcaactaatatttaacaagcatccactacagtaagccaagtgctgttctaaggtggtgagcatgcaacattaagaggggaaaaataccgttctcatgggacatgtgcgtgtccgtgtgtacaggatgggggcgtggaagatagacagaaaatagacaaggaactcaccattaacactcgctgtaatgtttagaagcagacagcttatctaagccttctgagtctcagcatgcttgtgggtaatgtagtattatcggtatgtacccagcaatacccctgtgaagaataaacagaaacacacagaggtgctatcatccttgcctccatctcaatattgcaaaacatacaagaatgcacatttcattctgtgattatttatttaactaggcactgggcattctgggatttgtacattcatatcattaaagcagtttcagccaaagagcatatatttggagatgttttaacatgcactgggcataagtgattatagccctaggttcaaggtgaccagtatctggacagagggagatatgtagaagaagtaccagttacgttgcaaggtaagatgtgcagaaccagcttaaagcattcaatactgtgccctaaccagctgaaggggtcattgatgccctttgaacagaagacagacatccttagttttgggtatttaaaattcctctgtggcaccaatgtgaggtatgagttgggaagagctgagactgagagcaaaggaacttacctaagtatagctttttcccccttttctaaaaatctaggctaaataaaataatgtgatgtgctagtatagccacaatggaaaattaagacagccttaatagttgggagatggaagagttaaaaatgatacaatttgggaaccaattgactattcagagcagcaaaggaagatgtgaagggcaaatgttcagctttcaagattaagtaaatggaagggaggtgcttccattaacaaacaggtaagtcaatagaggaagagcagcatgtgcagatgcgtttgtttgggggaatgttaaaatagcagcaaggatgggaccttggcactgagacatgcaggaggctgtctgaagttcatgatgattcctgagatgcagcctgtgaggagaggtcatggctagggatgcgataaggatttgtctgtattctgcaaagagtctgatgcaatggctttcaatcattactgcaaatccttcacaagtgtgtaaagagtatcatagccattactatattactatatataaaatatataatgtactatataatgtattatatataatatataatgtattttatatattatatattatgtatataatatataatatattttatatataatatagaatatatgatgtattatatgtattatatattgtatatattatattatacaattatagtatatattacatattgtatatattatatatagaatatatgatgtataatatataatatatcatgtattatgtataatatataatatataatgtattacgtatgatatataatatagaacgtattatatatcatatatcatatatgatatagaacgtattatatatcatatatatgatatatgatatagaacgtattatatatcatatatatgatatatgatatagaacgtattatatatcatatatcatatatgatatatgatatatgacgtattatatatcatatatcatacatgatatatataatatataatgtattatgttatatatcatatatgatatacatgatatataatatgtaatgtattatattatatatataaggtattatatataatatataatatgtaatgtattatatataatatataatgtattatataatatgtattatgtattatatataaaatatatataatactatatgtatacacacacacacacacacacacaaatatataacagaagtgggttgtgcacggtgatgacgattagggtataggaggtaagagacctaacaaagcacgaagtgatgccaagcgagagttttttgtctatgaggcatgtaagaacgctacaatacatgtgcattaaaaagtccagccagggacatatatagtctttttcttacatgtcactctactgaaatagtcttgaattattttatctgatacgaggtgaaggaaatgctatgttttcatcagtaagcacaataggtcttgtaatggagcgtacaggtttggtttggaaagatggcttgatacaaagctggataagagatgatcccctcaaagacacagaaacaactgttgccgagcttttaaggagcaggaaacagaggatgaaggggtgaggatacgaatttgttctctggctctcaaaaagaaaagagggaagaggaaaaggaagtaaggcagagaaagtctggaaccaagacagtttaatcaaagtcgagggcactagaatagccaaatgtcattttcaaggatgtgatagataccgttgaccctccacgtccttgggttctgcatccatagattcagtcaactgcagatcaaaaatattcagaaagaaattgtgtctgtgctaaacatgtgcagacacttttttccttgtcattattccctaaacaatgcattgaaacaactatttacatggaatttgcattgtattagtaaacctagaagatgatttaaagtatacaggaggatatgtgtaggttataagcaaatactacacatctgtagattttggtgtccttggaaggtcctagaaccaatcacccatggatagtgaacgatgactctaccgatccttgtctgtgtttttaaaatgagaatcacatcttccattctctctgccaccatcttcatgtctgctcatacatgcatcatttagtgggtgtattgcagaatgggctaattaattttatgtgtgggtctttgtaatggaacccagagacagggaatataagaacctggactcgcaggccagatgaggttgtgagaacatgagctgcctgtaaccgtgaattgcaatttggggactaaaacttggaatcctagagattgtctgtttgccgaggtgagatttttgagagccaggaaggttttctacccaatacccgatacatccccagtgtcaccttgtaagttttgcagataaacctagtttcgtatgattccttacatcgttcctagctcacctccaacaatcatcagactttgaaggtatgcaatgatgccagggactaagaattcctggggtgtctttgacctgtgttccaggatgagaccctgggaaggtccaggtcaaggtggattaattcagagctggagatgttagaggtgaagtcacttctagtcagaaatgcttaatgacaactcatcttgtactttaaagataaaatttctgagcatttctggggtcaaagaaccttgcagccaagctcatgaaagaggaaaaagagaatcttctgcaggctttgtttgccttcaggtttgcttgagtttaatccagaagtcgaaacacagagagtgggtggggtggagggttcccaaagtagaccttcccacccacttgttcattaggagaaatcaccacttagctgtttttgtctctgccgcctacccttccttgtcccacgcacttacattcagtcctgtgcactggaaacagactcccaccctctcaactgccaaacgctgcaccttgtctttgcttcacctcctggagtccattgtttcaggaaggctgctataggaactgaagttacttgcttgctctgggtaccttttaatttggggttctacctggtgtgtctcgggtctcttttgacatatgtcagttggctgctctgatagaacattgtctccataaattgtcacttttgccagaaatgatgataggaaagtgttggcaagaaaaaaaaaaaaaaagactgaagcagaatattttcttttgaaaagcttagggcaagctgtggatagggtgggacttactcctgctctaattgagtaaggacaagaaagctaggaaaatttcatatgataaaattaggtggctggggtcagcgatatattcctggaaaaagaaagcttgaagataaaatggcatagagtagttcttcacaaaagtgcttacgaggtttagatattgtaaaaaatgatgaatatgatgatgatgatgatgatgatgatgacagtggtgattttgtaagcagcatctctactgctgtttgtattgcatggttaaaaaggatactttctcattttgttcaacagaccagaaaaccctgttttccatctcttattagaaggataagatagatacttcttgtgccctcagtttcttcttatgtaaattggaactataaaaataatctaccttgcaggattttgtgaagatcagaaaaaaattaattaccatctggccagaagtaattttctaacatgtattacgcttgtcagtcttcacaaaatagtgaaggacttgacctgatgttgtgtgagatacagttggtgaagattttagttgacaagggttaatgtgtaagctggcattcatttgattcattagcaaggttaaataaattgtgtactcagaagaccagggcagaaaggtgatgtgtatgatgtctatacatttttgtatagtgccatgtcatttaaaaaaactttacaaaaagaaaattgtatctgaagttagtccttccataaatgtattgactttgttggtctcgtttgtgtaatttttttgcaaagaaggaggaatgatggtttcatcaactggtcaggggctgaaaatagaaatacctcataataatagttgctatatattgagtggttgctagataatgggcaccatttttatgacttatatatattacatgattttatctttcaacaacttaggaaggaaaagtatcattattctccttagaatgaaactgaggttttaagaacttgtatgtcagtagacatataatagcagctgcaaaggtatgatccagagatagatcttcagaccaagcagcaagactccaaaaggtgtactgctcactacaggtgtactcaggggagtacaccttttgcagtctcgctgtttgtgtttgaggcatacccacatatgaaccagaaagagttcccaaataccccatcgcaactccatatttcaggtggccttgaacgagcagggctgagtcattgaggaacaagaataaactctggtgatccaacaaattcaattcatttgacctttattaagcctctcctaagtgaaaggcatgctgctctgtggttcaggaaactcagaaatgagaagggtgtttggtttggtttgctgcagtgaacctgtgggggtaaagagaatagttattcaagcctaaagagtgtaactattaattgttttttagtctcctcgtgatagctaacaagtattgttgatacttgttgtgccagtgcctatgctgagaagcactttacattcattatctcggtggttcccaaatgccgatccacagactcattggattctgtaatgacattttcgacagactgcagctaaatgagaaaattaagggcaatttagtgaaaattttaatagacttaaatttaatcaatttgaaggactgtcctttattttcagattatgtcctcctttttttttttttttttgcattttcgtgtaaaatgctgtttcttttattaaatgcttatgacagtagacagtgtatgtgagtttatgtgtgtatgtatgaatgtactaccttggcaagaaatttaaaagctgttaattttcatgcagtctctttaccatttttaaacttttcttggaactgtccatgtcattgagggctaggggataagaagtctgagaatcattatagttctgtaagggtgctaccattggccccattttacagatgaaaaaaactaaggctcggaatggttagctcacatgctcatgttcacgatagcttgcaagtagcagagcttgaatttaaaccagtttgtgtgtttctgtagatgcagaacacctgcatgatgggcatatggctgcttttgctgcaatgaataggctccctagcctgtccctggccatggatgtgggccatgcaaccgttttcagagtcccaggactctgggcctttctttcgggtgcagactgaaatccacaatagctttagacattcatggtgtttcctaggagctagtttgcagcagttctattcctctacttggaggaatacaggagttaagagcctagctttgtgtcccttccctctgcccctgagtcctgtgtttctgtttaccctcaaaaatgtgagcagtataggtatgtgtaaaggtaaatgcagacatcctgcttagtggcttacagcagaacctcatgtcaggggaagagctgggttgaaagatcccgttttccaagcttgcactccatgggagccatagtcagtagccagtgagacgacaggaggagagacaaggctcaagggtcaagggagaagacactgtctgtacctcctgagctttctcttcattgtgcctgcagggaggagggaaggcagtttgggccatggcttgtaggaacaaaaaaggacaaacttattttccacatcttcctgctttatatgtgaggcttgatgtaaagacaaactaccccaccctgtgagatgggtaattgagaatgagacataactgggtttggaaatcagttgcatcccttctcttctccagaaacatatgcaggtttccaacctggcagtctgtttctcagcagccttggcacctgaggaaggggtaagatgaggatctgggtatttttattttgatttctgacattgtccctaagaagttatgctgtaaacggataagagattctgggttactgaaatcctgtatggatgctaaggtgctatgtagcttagtccattcccttttttgttgtggatgttaattatctagaatattgcaactcagtagtggctttaagcaggttttcatgtactagccagggaaagttaccaccattaaaaaaaattattctttaggaacgtgtagcctggggtctttataataacaacagttgtagtagtagttgtagtagcaatgatgataatataactgtttcattttattgtaaaagtaatacacagacacattcttattgtgaaaatctaagcgacataaatctgtacagagtaaaaattgaaatcccccccaatagcccctcctctattaccctagatctaaaagcatttattggattgatttatttgtttccgggcccttttgtatgcacttcacatgactgcatgtatgcctattttacgcacatgcatatgcacatacttctgtggatgtctatatgcatccacacacatgtttttaaagaatcgtagagttttgctgtttgttttggtttgatttttcacatgtgaaattttgttatctatatcctgaaacttcttagagaattttcttagagatttttccaaggaaagacactcagatgccccgcattctttttaactggtgcattgcatgcatgtcctgtaccttgttttatttatcccctgtttcccctattgctgtttattatagttgacccttcagcaacatgggggttagaagcatcaacccaccacaatgtagaaaatttgtgtataggtttttttttgtttttttttttttttttttttgagatatactcactcttttgcccaggctctggagtgcagtagcatgatctcagcctaccgcagcctccgcctcctgggttcaagtgattctcatgcgtctgcctcccaagtagctgggactacagatgcgtgcgactatgcctgagggctaatttttgtatatttggttgagagagggtttcaccatcttggccagtctcatcttgaactcctgtccttaagtgatccactcgccttggcctcccaaagtgccgggattacaggcatgagccaacatgcccagcccaaaatttgtgtataagttttgattcccccaaaactatgattagcccactatcgactcaaagccaacagtggattaaaacgtattttgtatgttacatgcattatatatgtattcctacaataaactaagctagggtaaagaaaatattaagaaaatcataacgaagagaaaacatatttactattgatcaagtagaagtgaatcatcataaatgttttcatctttgtcattttacatgaggtaggctgaggaggaggaggaggacgaggaagacaaggggttggtcttgctatctctgggtctctcaggtggcagagaatttctgcatatgtggtcctgtatagttcaaatctgtgttgttcacgagtcaactgtatttgcttttacaagcaatggtggagtgaatatcctggtttatgtatcatgtatctacctcaaatatttcagcaggacagatatctagaattagaatagttactttgaaagatgtgcgtattttagattttgatagtgagcaccaaaatattaatatcatctccaggactgtaccagttttgactcccaccatctgtgtttcaggttacccatttctccacagtgatgtcaaatctatatattattgataggcattttattcgttatttgattttatttgttaactgatgtcagtcttttaggcaaaagatggccgtaaactgttctaaaccaccaatgtaactttgaaaagctcatttgtagtgggagcgagttgtgaactgggtattgcctgcgcttgtatttctgctcttggaagcgtggtttatttttagtcctggactcactgacaacccacacccaaactagaaagctagaggagtttgagggtcctttacacagaatcaggctctaatctcgatcctgtcattacatgcaaagcaattgctgctgaatggttggaattggttctgcctgggacgaagccctttactctgaaaaaggagcgctgtgctcatttgagcactgccaaaatcctggaccctctgactcagtgtggagtgatcgtgcttttgcctagagaaactgtgtctgagaaatggagcttctgcaaaatacagctcagagggaccatcaggggttgagacattctagaggccaacaggccagcttaatgtatacattagaagtgccaaacttctcacccctatccctagtagattgacccaagagaactacagaattcatgtagacatgctcctcagtttacaatggggttatgtcctaataaacccattgtaagttgaaaatatcataagtagaaattatgttttcgacataggatattttcaccttaccatggatttatccagatgtgaccccatcgcaagtcagggaccatctgtattaaacaaatgtgaggcttatgcaataagattggaaggagcgggatgcaagaggggctttcttgaagctgaaactgcattttttcagagcaagtgtagtttttaggtagatttcactgccgtctcccttaccctggtttccctaattccctgatcttgatcttgcctgctatgcttcccacagcactcaccaccatctattgtactgtacttatttcttctctgtattacttactttctgctgcccctcccccacccactagaatgtaaactgtctaatgtcagggacctttgtttgtccggccccactgatgccgacctgggggctagaacagtgcctggaatgagatcagcactaactaaatatgattcaggtgtttgaacaagccagtgactcaaagtgcttttgatacagataaataataaagttttctaaagatactttcatgctcactttaatgaagatggagactatattgtcgtccacattaaatttggaagtgaaagtaaaatatttctaagtcacatcttgacgttgccactgagctaaccccagtatagatgattacattgaagttcaagtccttctttctgtctaactggagtcttgcttgctctgaggtatggcaactcttatagaaagtattttttttagtggaatgtctgctatttcaacagccttgggaagttataataaatagttatgaaaatgagaaaagaaaaaaatggtttccattcttcttttaaattgctggcaaagttggaagaaaaaaagttacaatattattttatgagtcaaattaaaacttgggtagttgccttctgcctaaggaagtttcatttgaagatgacattattgattgccaattttcctgcactttttcagcttcctgtggggtatgtataaccattccattaagggtccttgtagctgaaatgcaggcagggtggcccttgaatgcatatgaacccatgtgatgttgaatgtctagaatttttttttgtggagagataagagtattttctttccccacttctcccatttattgatgttggagaatcatgccagagctagtggccttgatatggctctttctcagtctcttttgagatggaattcaaatttgctatccccagatgcggtttaaaaggctggcaaagtgttgtcatcaagtgagcgatgattgtggatatgatgctaccatttgatttggggtcattggatgccctattcctgattaaggagcactgatgttatcaatggaaaagtgttcctctgggctccttaatatagttgcagtgtttatgggaaggggacttgtccctgtgtgtgattgtgtttgcatgcactggtggagagatgttcaggtttagttatccagagagcagagcccgactccaaataattttgatgtggatttaggtctggttctcatgttgtactttgcagatcttcagtgtgtctgactgtgaaaacttaagtttaagggaatgtcagagccgttattgcaagatggatctgtggggatctaatcactactgaggggttccaactttggggagaaaacggactggaaaatctgtattgccttagtgcagccaagagcatttattgggtctttacataatgtatttgtttttcattaaaccgttcagataaagtcttattaaagtgccatgtattatgtatcatgtttcttatgaaaatgagctgaaggaaaaaattctctcctcttcttgggttatttacaggcttttctaatgccagcaagagaaaaaaaaataaaggaaagcagtgcgaacccgtccgtacagcagattgcttgacgcaacagtaaagaatgggaaagggagagtgaggattggaaaggtagaatggttggccttttattccattcgtgttctgtggagtgactttctctttagttttgtgaatgcaaaaataaataaataaaggcaggtaggaagtaagagaagaaaagagggaattcttatattatttgttaatcaaagcttgtcccatgaatgtgacctctgatgcaacgtacagcaaacgtttttcaaactaaccactgccagcaccccccaataaaagcagtacagaatagcagcctctactttcccactcccctggatgaacttctgcctagggctaaagggttaaacatgctactgtgtccctgataaattgatgggatgtgtgagccccagagaggttggaggcactggttttgcaagatgaaaagtggaaagaaacagcgggttggggcctagtgttaggcagagtgaagacttcatagttatttcaaacagaacgacaacaaaaaatagagccgtgggataattagttttcttttcttcagaaagcattttgattagcctgcaaagtgagttgtgccttgcgagctgatggctgggttcagagccttcatttggctgaggatgtcggggtgagccctgaggaggaggggatatttgggatgtccctggtggccagttccagggttctgccccaaatattcttttgtgagagagcccccatcccctctcaggtacggttccgtcctgcaggtcagtgagaagctgtcagcaaggtttctttcaggaagcccaacaatcaaaaaagctgctgtttagacagctgatctcttggtctgaaaacaaaaaaaaaaaaaaagaaaatccaatcactgggtcaaaatctatattaaaaaaatatggctactcttcctgatcacgattttattgctgccaagaatgcaagaatgtgcttttttttttttttcctgtcaggaccaaggacgagttagagtcttaatattttctttcgatttgcagatcacatcctattttattgcataaagactaatgaaatctactaatgaataattattacttcataaaataaaggggaggggagacccgtttgcaagagcagaatgttaatttggccaaggagggctggacaggcaagaataaaaaaaataaataaataaaccattgtaatttgctccctgcagccgacggagtaatctcttatcagacacggacttccctaccctgtgcatttataatttgagaggagcgggtgttctgggctgggagaagcccccttccagtcgccccgagctggcacgttagtccaacaggcttgatttccacgccagcctgggcggttgctctcattgaacagctcaggggctggttcgctggctcggggctgcctgcccaaccaaggcgaggcacagagcgaaagctgcgccccaaacgcccgggggtgcatcggcgcttcggtgctctgctggggggcgcagaaacctcctcccctccctcagcccaagctccctcctgcccccagcccctaacgtctcagcactccacctcctgaggaggggaaatcccttttctgtgtttatttggcaaggaatccggcaaacgcaccgccaccaacatctaccactgtgggtcccagctgggccatcgcgctaattgtccagctcgcctgatgccgggcgcgcggggcgctcgctcgcctgctcaccggcagagggttttagcagaccgaatttaaattttggtgagtgtttttttgaaacaaacaaaaaaaataaataatttttaaaaaaagcgaaggggagggaaggaaaaaaaggaaaaaaaatctttcccctggacccatttgacaaatgaggagacagacagcatcagaaccaacggagtgagcttcagtgtgagtcaaaacctctcttcctctctttcaatctctctctctctttaccctccctctcgctctctctctctctctctctctgtctctcccctccctctctcttcctctctccctctctacctccgtcccaccccttcctcctctccctccctccctccctctcgctatccttgcccccctcccattcagcctcttcgggagggcagcgcatcccctgccccttccagagaagttccctctgccggttctcgtgtcaccttcacaggggtatggggtggggggccccttccactttccgggggatcaaaaagcaggcccaacaacccagaaaagccagacgaccgcgcgaagggaaccaactagtttccaggtccccgcaagtgttttagttggaggcagaggaacgccgggatctagcacatccccaggcggggagagccagggaggagggaccggcggggtgcggtggggggagggaggaggaaagagggggagagagacagagagagagacagagagagagagagagagagagagagagagagacagcgcgagccaccggtcattgacttagataaccagcaaaattaaaaaagaaaaaaaaaaattgtagcgcccaggcagagagcaacgtgattgcattcaagcgtccccactcgggctcggcgggcgccagagagacatgatgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttctgcacctgtccgaatactttaaaaccgcctgatgcccagcctgggcaccggaagtttgaaatggaaaactgccttttccttgctaccatcttccttgtgtcagtgcctttcgtggtgatctgagtctaagacccctttgatgctaagagtttgaatctttgtggaggcattccggtgcctgtagtgttaattcagctgatttaatagagagtggaaaggagaagtgtgtggtgtgtggtgtggtgtgtgtgtgtgtgtgtgtgtgtgtgtgtgtgtgtgtgtgtgttttcctaagtttgtgtggtgctatattcggtccgcatgggatcgcagcatttgaatttctggagtgtgtcagccccagtctgccttcaaactcactggcaatgctgtgaagaaggtgagctgtttaggatgttgtctttgttggcatgtgttagggtgtttgtgtgtgtgtgcgtgtgtgggtttttttttccctttcacttctccttagtggtcttgctgagggagtctgtgtttgctttattttccattcattgtgcacatttcagtcttttgacaccttactctctgtctttctcagggtgtttccttgggaccctctctgctctgtcattctttctttattggaagggttgcttcctgagttggttcctgggcttgggaaatagctcagcactgcccttgtagggtgacaggccagctctctgtcattgggcaggggcagtggatgtgaactgaagggctagaaggggttttgtcatgcagatgaaaatcctttctccctcccaggatctccatcctattctatgaaggtttacagtgattatactcattttatctgtttttccacggactcacttcaagagtaccatttgttaacatgagtgtgtgaacagaacttcctatgcaagagttgagagtggccctcttccccaagaccctcaatttcaacctgtgttaaaggaatgtatatttttataaaatgtcaggattctgttttgaacatttgggtgattttctatcaagttggttgactccagaaaatatttcttaggtgtattttctgttgcatgtctttttgagaacagtcttaaaaaaatcttgggaaccaatttgttcttttaaatattattttattacgttcattattgagtaaatcgtgccagaagacatttcccaagagagtattgataacatattatatgcttcatcttccacaatttctgtgcctttgctgtgggtgtgtgtgtaaatgtgtatgtgcatgtgcgttttataccagttatttccaccggaagaaaattctaatgagcatttctatagatgctaagcctcagttggatttatcaaattattactgagttgatcttttgccttttacatttacttctttcatgttatttattaatcaatttgaatatcatttacctagcaagtagaatgctataggtactcaatgttctccgttcctttgtgtggtggtgtttgtgtttttttcaaaaatacatccatgtttctgccttctagatttttaaattggcttactcatttgggcacaacttaggagagaagatagtgactttgagtgagaggttattcttgccatgagaagaacaaacatataagataaacacaaaggttctcagcatcttccaggcagtctctcccacgaggaaaaacacccctgctctggaaaggggaggcttgaagaaaacattggcagccacaacaaatatttagaagtgactaaatcagcatcatggttccatatgaagatagatggagggtggattttgaaatgtgctttggaatgcatctccccctcccctgaaaggacttgcactgctatctgtgaaagtgtttataatgtgatactatgacataatgtgggaatggtgtgcgtgtgtgtgtgtgtgtgtgtgtgtattttctctgagcttcactgaatacctgaagtataataaaggcagtcatttatttttgcctgtttcattcagaattaggttttctagcccttcctggaagctcaccgctagggtgtaagtgatatacctggagtcatctgtcctggccattactgtcgtgatagttcgtttaaaagtctcaagtcacttattttatttagcattccagacaatcggctgattaagagtgtgaaatagtttaatctccacatacataaatcatatcgataagtaatatcttgtacccagacaccactactatattttttatctgcctttaatctgtagctattattggatctctagctaattttggtgaacagaagggtaatctttgatctcaaagtaaattgatcaagtggacgaatcaggcaacatttatgataagtaacaccttcactgaaaacaattttattttataattgtttagaaataaacataattcagaagtctttgtcattgagatcaccaattacataagaaagtaatcaacccacattgatcttattttggagcatttatcattttgttttataaatccacaaactctgaccaccggccatcgagtcttccctgaagtatatttttctggaatgcagtttcatatggttatttcttatccaataactaaggaaaatgacttcattaaatgctttctttgtctcagcatgaacatccaacctttcctcctaaattctcacagatttatccataagacaactcataaaaacaaaaatcaattggggtgcctcagcatcggagtctactctgaatggccaagtgtaagtggcaacatatcacttttgccacgaataatttatttacttaggccaatgaagaagcaactttgatgtttacattatttgacttatcctgtttcacttatttgtatgtcccaataacttttatctagataagtgtttacttacagctacgatttcttttcttttctccttctcctcttttttcctccacatccaagatgttactacagtttagagctgcaaggtgggataatgctaaatagtttttttggcgtctagatatcagacccagtgatgtactcacataggaacacacaaatttgtatacatacacacagacacatatacacacacacctagtatagagcatatattttgtggttgtcaaccactttcagatggaacggacaagtagtccttggagcaactggcttcaatcttgctgtccagggaaagtccctgcctcaatctcctttcctgagtggcttcatgctgtgtcttctttgatggtgaatcttcttgaagctgaacttagaactcacatatccccaatacttaatcttccacgttccaaagtaagtactcatggaaccattcttgctttgaggaataattctgaatacaattccacattagggggtttgcagcaagctaggtcaaaagagaacctattttgttttcctgatagagaagaaatagaaaacagccacacacacatgcatggacacacaggacacagaaatctagagatggtttatttctattgtaagtaatagagggcaaaccttatagcacccatctcatggtaaggtatggtgaggcaacagacaggatggatgatgagattcgttttctgatgcaaactgcgtgtcagattccacccagagctgtttttttttttttccactgagtttaatgtcctgaaagaggatcagtagcatattaacttaattttctctgttcttacaccaccagcgtctctcagtactattctaagaaagcttcttatctgtcaagccctatccactgagaacctttttatcagcctaaatttaaaaatacgtcaaatgcttaaaatccacattagagggggcagaaaagagcctctaaagtgggccatgccactgtcaatattcgaagattggtaatttttcccacttaatgatgatccatgtggtttgttttaagtagtgaagtggtttgtacaaagggtaattcccagtaaatgaagccattgctcactgtggacatcttcagatcgaaagcaattgaactgaaacctgcatatcaaccctttctgtctttaattagaaagcgattctcagttcagggaatcacctggggaagatgggctctcgcgcgaaggctgcaggcgttggggagggtggccccatgcaccagccacggttataaattttggaaacattaggtaggtcataacaattatgactgtgtagaaaagttcaattctcattgcagttacttaccttgtgttactccatctgatgatttatagggggccaaatggaatttatcacattctttctttttggcttaatcccgtgttgatttattagatagtgctatggattgggggtggtcgatagtgtcagtaacgcagaaaagaattaggatagattagcttcatgtctgaattgtttaaaggaatttaagtggctggaatgagcacatttccaggcccaggtggctgcctgatagaagaaaggtccctcagtctctttctagagggatgtcttacgtcgtaaattggttaaccaatctttcttgtttctctgatcttttccgattaagagaaggcatgaaatgttaggctgttatcagccaggtaaggcccacatttcaggtgagctgggggtcatctgtgcttcccccctttggggaacctatggagggccgcgtgttgtggacatggactgcagggccacctgggctgcctctgctttaaaattacttaatccaacaatcacttctgaaaattgtaagcatctgttcatccacagaccaaagccttgtgccattcgcctgctctgcctgccattttgaggcagtttctgtgttataacatgcaactggccgctcctgcctttgcccggctggagaaagtctgtgttattagtgctcacccgccatctgttttccttacagctgacccttgagtaattctccagtagctgatggactgagggtagacagtcttttttagggttttctgattcatttaaccaggttctctgccccaagaggaaacataatgcttgtttattcatattggccgggtgaaaacagtgtagtttgtcaggcaaataatagtcctgtggaagggaacgaaattgcagcattgtaaacaaaatcaggttgctgactctgtgcctaagggggttgggtgatgagcagcacatgtcatcccgtgaaggaagcagagctgacaggtgtgggtgtaattgtcccatctgcagacccctttttaatggacggggagaagtgtcccaatgttctgtttaattcagttaagaaaagcaaagaaagttccattcatcaataaagtttcctattgccgggtgctgcccaagagaactctgccgggctgagcgttggcccgtggctgttggcatgatgcagcttgcctcacccagccctattgagggcggctgtgtcagatagggtcagctctcaggcacaatggcccagaagagccctggccctggccctttaaccatgctgaatacaggtgagctagccaaatgagcaatggacccgcaggccgcctctgctgggagacagagctggccagggttctctctgaaggatcctgaaatgcagttcctgagcctggcatacgatgaggaaagagcttgtgtggttggaatgtcctggctcctgagagggtttggggaaagaggcttttcatggttgtttctgatcttcctgtcatgctatagccctgatggattgatcccggctaaaaaagtgacagaatttggaaccagggttggtggggaggaggtagagagaaggagaagatgttgatcaaaactgtaaaaactgacgttaactgtggagcacccagagtcctgttggtatgttttatcaaaacttcatcaaggggcatacttattaacatggaaataattgtcatggtccagtatttctcaaacttcagacattcaggcaccacttcctaagtcctgccaatctacccattaccagagttgatatctacttaatattttttaaaattaacttacatattaaacatagacttgcccaaaccaaataaaacacagtcactgaatcacacctgtgatcacactttcccagcatacgtggaactaaatgtgtattcattcacctgtccatccacccattccatgttgatggaactcctgataggtttatggaactccagctgcccttctagactctcccagggagcaaagcaaaggcccctgtcctcacagatagtctgttacgttgttcatctctttgccatcttgtgaaccatgcatgcagtacaacgctttggaaaacttccgcttggcctgctggattgcctgggaatcctctgccgtgtccggtctggaattactccttccgctaccttgacccaatttgcaaggggcaaggctagagttaagttctttgtgatgcttttttttccatctgccagatcagcagccactagtgcacaataaaggaaaatagccatacattcaacgtctacatcccaaggagggctttgagatgatggagctgggactgggaaactgctgtggtccttagcactcagccaagctctagctgaagagcagtcctaccctgttttgatccttttctttatgtgtcttgaaacagaatcaaaattaggaaggggaactggagtggaaagcattcagaaggttagtgtgtgttcccagggatgcaatgactattttttttctccccttttgtggccatagaacaaagtagaagcaactgtaggatttaagtgactccaatttcccaggcctgatgagtaaatgcataaaaggtttagtcttgatgagccttttcttttttttttttttttttggcattcgatgtttgctcaggattcgcctcaatgactagattccccttatcaaaaacagtaacaaacatccccggtttttcccttccatagatcagcttcctcttgctctgcctgaagccaggcacggggcaagccctgctcttatggaaaggttgagagcaatattggtacctaaacccagaaggaacagcgaggtttacacactgcagtagccagctgtccatctcaagtgtctcacaaaattcagatgaaaaacccagatctatttagagccagttggtatcatggtatcagccttcccaaaagtacaggtttttttgaaaaacgatagtgtttctgaagttatatgtaggacagaagtcatgagctgaaggcttaatcccaactctgttattcaattagctgatccagctgaattgagcaagatagtttttttttgtttatttggggacttaattgctccttcagaaaaacagggattagaacaaccatttcatactgttctttgtgatattaagtaagatgcaaatgggaacacttagctcagtgcctggggtgcagtgagcagcctatagatgtttgataaagaaatgaaggaagggccgggcgcagtggcccacgcctgtaatcccagcactttaggaggcagaggcaggtggatcacttgaggtcaggagtttgagaccagcctggcctacatggtgaaaccctgtctctactaaaaatacaaaaattatctgagcgtggtggagcacacttgtaatcccagctacttaggaggctgaggcaggagaatcacttgaacccaggagacagaggtagcagtgagccgagatcgcggcgttgcactccagcctgggcaacaagagtgaaactctttctcaacagcagcaacaacaacaatgaaacaaaggaaggcaatatgttaaagaaacgtaggatttgtttattgaagctggacataaacttctcgtttccatttctctcaaattaacatgattaatacacccatggcctgccaaggacacagacacaagggacttgggtgtcactccgggtcttcttggttccactaccctgtttgggagctcttctctttcttcctccagtgagctgtcattcctgcttgtgtcactggattgtaatatggctacacagctcaattaatgctcagtgtcaggaggagggaaaataaaaattgtcttgctcttgtcagtagcgaagttatttactttcaaaagctgacagaatcacactgcagggccttcatttatttccattcagaacgtcattattctgtgatgccagagacttgggcacacgttgaagtttattcccataagctttaatatggcggggccctgctaaagtgtagatcgtcacccaggagagtctgggagagtctggcggagctctctgggggccccagggtgcctgggtgcttggcactgatgtctgggagggtaccctagtttcaggatggaccggggaagctgacacgtgcattttcatgccctggatctgttgtaggagaggcagcgtgttccccactgctgctcttccttctgaagcaaaagaaaggggtgtgggactcgtacttccacatcactcttcatccgggccactcctggaatttctggaaacacaaaagcgcctcctgaaagtggctttgctttggatctatctattgtctctgcttaaactcgttgacaggttccctcaaccaaataatctgtataaaactatgcaattttttgtttgtttgtttgctctctttctttcttccttttccccctaagggtttgcaatgagcagttaacacaggaaggggttgagtggagaaattctcttttcttcatggtgcagtggcagaaccttccactgggggtctccatttagagtacgtgactcaggattcctgaagactttcttttttcctttctttcttcttttttatctttttttttcttttcttgtctttttttttttaaggctctttggttccgttcaaaaaatgaggctctttcggacagcagtaggagaggcagcttgtaagaccatttaggtaacgagataagccagccttcttccacaatgatgatcataataataaaataattaaaataatgaaataatcaataacttttatggagtgctttgtgacaagcacacgaataagcacttttacatggattatcacatttaatcccccacaaaaaaagcctccagggagttgaaattaatggcttcatttttagatgcagaatccaaggcttaggtgggagagctgatatttaaaaccagacacttttgccccagaaccgacacttagaaccacgattctgcaccatccctatgtcctcctcctcactgtgccggccagtggctggttctgtatgatttacggagagacctctgccaggttcctgcgttggaagaatagctccaattgatggagtgggcctcttttcctttaaaggcaggacttgccaaaagaggaaagagttcaggcgacctgtcaactttgatgctcttcccgattttgttttttttaagtcattacgattttgtttaatgaattgcaacaaaccatgaggcttttggacttggggaggaggaagggagaggggaaagaacgaggctgtgagaatcatcagcactgagaatgatggagtgtatttctccgcaaccaattccaatccccaaatctctgttgtactggggagctctccaactaacagaggaaacgcagtcactgcccggcaccgtattaatgatttatacaccccgcaccactgcttttgttcacttgcggggcctggtcgtgttcataacggaatttcagggagtggggtcctgccttgccatgctgttttgctcagtgcagtgaagactgcttcataaatcaaaagaatttagtgctttacaaccttcctgagctctgagatggtgtgcgcctgtgtgcggttgtgtatgtgtgtgtgtttaatcagattcacttagacacattttcattgcctttctgtaaagaatgaatgaagaacgggatgcgatctgtcttaggtgtttcagggctgattggtttgtttcacagtggcatcacggtcctatttgtttcccatttggtgtttatgctttatggtgttgtctgtgaaaatgggctgacactcttttattagcataaagagattcagatcacattagaatcctccgtccttctatatcatcaaaaacaacaggcaggggagagggcgagttgactgtaagccgaatcaccatttgttcacgataagtcaacaggagcttgatgtgatctttaaacaaaggggtttttgagccttttaaaaatgattctttttcaatttttcactgaaaaagaatgcagcttcgttttgaatgttatcgaggacatttattttccggattgggaattctggatgtaggaaagtttcttctcttgagtaagccacagaaagctctaattttaacctccgcttttatttttttcctaattggaagaaaacaaatcataacctcatatattttatttggagccctcaatcaatctttcaagataccagcagagaaaagctctttttttttttttaatgaattgcacttgtacttgtgttttcttaattatgtcatgcatttcattttgtgtgtggtgatatttctttccctatagaactgagaactgaaaaccaacagaagacagagtaggagtttgagggggtaaaacagaatatttagaaaattagaatgatactttaaatattccagtcaacagtaatatttttgtctatgataaaatcttgattttaggaaatgctcttgagttaaaaaagaaagatacgtaaggcttttaggaaataaacatgtcattttagtagaattctgaagtgaatacatgaaggaataaatgcaaagacaaatgattaaagccctactctaccctacccccccccccatactgggggcttgaatttcttttacaaatgtgaaagttttagctatctggttcttattaacatttatgcttataaatttttttaactgtccagtatgcttgtcagtaatgatgaaattgaagcaaatattcattgtggaagatagtcttttatagccttcctgaaaagtggagaacagaatatatatatatatatatatggaacattacacacacttttcatcatgggacatatgatacagcattttggactcggaaagcaggtgtccagcaaatgcactttacatttatattgtactgatttttgtatttttgtttgttctctattatttgaattcgtgagtgtctcattgtttttaattatgtctacatggcacaagacagcagtcaacatctgctctattgtttacttggtttacatatatctttgatgggttactaaacaatctatttttcaaaccccaaacagaagaaacaagctgaacccatattacagcattttgtaaagacccattatgcaattagcacttgggatttgtgcaaatctggtgattcacccaaacaaacatccctttattctgatagttcttcctggctttgtgagaaatatcagtttccaaaaaaataaaatcacatttcctctttaatcatgcagcgtgccaagaagattatgtgtttatatgagggatggatcctccactttgtgtatcagagaaagatcaacttttcaaaataatgatgtctttaattcaaggcagcagttactatattacataagacaactatctgcttacacatagcagacttttgagagttacatggtactattggagaagagaaatgctatgtttttacctgtttgtataatcttcctaacattgcatgatctgtttacagaaggcatagctggtcatctcttgcaaggcatgtgaggcccagaatgattaagtcacctcaaatctgattatttctctgaagtcaatggttaataattaatttactcactcattcatgcagcacatccttatttagcctctgtctcagagattgggttggtcattgaagggatacagacaaggaaagcaggtctgcttttcttcatggaggttacaagtctgtgggagagagacagcccatgagcaagtgatcatcacataactgtgccttgccaggtgtgataaatgctctgaaggaaaagagtgggagttggattcaggggtgagggaagcttttttgaagaagtgacatcaaagctgagatggagtgggaggtaggcaaggaggtggggtcagggtggaagagaggattcacactaaggcatagagtgtgtgtagtgcctgttgcttgcctaggtgtctttaagatgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatttagcctttttacaaaggccagtttggcttttctgcagagaatagagggagacaagatagaaagctgaggacgggggtgtcaagtaggaagtcactgcgatactactggtgcaagctgatggtcgcttggactaggagtggacagaaaagaaacggccaggagtaaaacgttttgaaaatcaagcctgagattcatccccgaagctgatgttcagccagaagagaagaaatgcaactccctgaagtcagacttcggcaggctttggtgaagtcaggtggcactgacctgggtggtatgcagcttcatggaagtgagtgacaggccagtctcagcatatcttaggccaaagctcccagagctcagaatttttcatctgaactctaccatcaccaccactatcaccactgtcaccaatccagtgctattatcaccaccactatcaccatcgccattaggaccatcaccatcacgaagcaactggtctcatgtatgagttggtagcagtcaccaaagacaaaggcactcaccagcttggtaaggtgctctgtagcatcccacttctaatatggtgggtgagaagtggggagtcatttttatgaaatgtccactgagcagtacctccacccgctgcctccagccacaggagtacaggagtgaagtgcattcacgggaatgtgaaacagaactgactttgagtctgaaacaaattacaaatcttatgggcctccaactagctctatgggcatgtttctcgacttctctgcagtttcatttctacatttacgaagtagaggtaacagcaagaccacaaagacatagcattgttaggagtatggcacgagctagtttgtatactaccccagtacagtacccagcaaacagaaggagctcaatacatacttctacttttgatgctggaggtgatggtggtgatggtggtggtgatagtggtggtgactgtggtggtgacggtagcgatgatggtgatgatgtgaaaatggtggtggtggtgattgtgaatggtgacggtggtagtagtggtgatgaaggtgatggtggtagtgctggtggtagtgacggtgctgatggtgatgtagtggtgataatggtggtaatggtagtgacggtggtaatgatggtgatggtgatagtgatggtgttgatagtggtgttggtggtgatggccatggtaatggagttgggatagtggtgatggcagtgatggtggatggtagtgttggtgatagtaatggtggtagtgctggtggtgctggtggctctggtggtggtagtgacagtgctgatggtggtagttgcagtggtggtggtggtggtgatgatgtttggtgatgagagtgattctggttagatgcagcgtggtagaatagtttcacacataagtacctggcttcagatttggttcaagtctaccacttaccacctttgcaccgttgggcaaattatttaacctttctttgttttaattgtctcatctgtgagatggggatggtgatattcattgtcattatgaagactaaattatttaatgtttgttaaaatcagaatagcgttcctataaacaaactcttagacatagagaacgtttgttaaataaagtgtcagtgcagaatacagcttttaacaaaaaggtacctagtggcttctggacttctgctatattcttgattttgctttttatagcaggctgaaaaggctgtctttgccttctctcaaccgccagacccaccccccatctctccatgtgttctgcgtagaacaggtgtgtggtgagccgaagttctggcagagcgcaacatgaaaaagactcccagtaattataaaaataacaacgaaggctgcttagcgaggtaggcagatgagcacaccactagccagaatgataaatagcgcctgcaaatgttaggtcccagtgggagtatgggaacatatgggatgaaccacactaaaagttgggcatcattggtaagttttagatggttaaggcaggctaactccagtgccaatttttttcttctttctttgtttttttatcctaattttaaatccttcagttcccttttgtccctttgttctattttggtcctaaaagaagcattcatctttgaggccagccagggaatctccaaggaagtgaggtctgtgccgtaatcctaaaaacaaatggccaccctggagtctgtgaatttccacgttgagctctattcaatattgttgggggagatgtaaatgaatgtggtaaatatttaatggaatgctgacatgttgagtccagacctatgataggtgggcgtgtagaaaaattagtgcctaaccagctcaataagtttacaagcatttgtagaagaggcaaacaattcttgtctgccaaacattatttaaaaagaagacgtggagggtggtaggttgatttcaggtcagtgtttgtatgtctgggtctgaatatagtttggagactgtacaatctgtttggcatggctctgcagcagtgggatttctctggaaggatattttggaattcttgttcaccacccaccatgcttttcctgggcctcagaagagatttcagcatcgaggcgagatttagaatgtgggcacctgagtgttggtgccagctccttagtagatttccagggttccttacttagcaattacatcaacatccttggtcatgtgaagcaggcagaggaaaggaagtaggatttgggatcgggcaggtgtggctttgactgccggccctccctgctcaagttgccatgaatgatgtaaggcctctgagttctaatatcctcatttgtagaatggggctattatgagtaccaataccatggacttgttaaaagactggatgagtcaaagtgttggagtgcttagaattgtgtttggcacatagtgagacctaggaaagggtttgttaaaaaattaagcagaacatatcttctaggactgccttttatgcaagtgtacgtgtatgtatgcattaatctgtttttttgaaagttaccttttcttaaaaaaattaattttattgtaagttgcaggatacatgtgcaggatgtgcaggtttatcacataggtaaacgtgtgccatggtggttgtctgcacccatcaacccatcagctaggtattaagccccatgttcatcagctatttatcctgatgctctcccttcccccaccaccccctacaggccccagtgtgtgttgtttccctccctgtatccatgtgttctcattgttcagctcccacttgtgagtgagaacatggagtgtctggttttctgttcttgtgttagtttactcaggttaatggcttccagctccatccatgtccctgcaaaagacatgatctcatccttttttatggctgcatagtattccatggtgggtatgtaccacattttctttatccagtctatctttgatgggcatttgtgttgattccatgtctttgctattgtgattagtgctgtatgcactaatcttacaaccacttttgtactagtccagaatctattagttttaatggacagctacccaaatcaaacttgcttaagcaaaaatggggatttgttgattcatgaaactgggataattgaaggtcagtcggtagtaagtgaatcatcatttaaacgctcagcactctaattgagatataaacagatgtgattgtaagaaacaccatgaataaagctcaaacacttacaaatgggtgcaagcccaaagaatattttaagtatgtggttatattacttagagcaaccgcacaacaaccctgtaaggggagtgttattgccccaaatttataagggaattaattgaggttcagaaagtttaagtaacttgcccagggaaaaacagccagggattttcagagcccaaatttggacccaaacttcttatggcttcaatagctgagttcctgatcaatatgatacattgctattacgataaaaataagtactttttattagtaaactggagaccagagaaattatctatctatctgtctatctatacgtatacatatacatatacatatacatatacatatacatatacatatacatatacttatacttatattgtttgttttttgagacggcgagatggtgttttgctctgctgcccaggctggagtgcagtggtgcgatctcatctcactgcaacctctggctcctgggttaaagcgattgtcctgcatcagcctcctaagtagctgggattacaggtgtgtgccaccatacccggctaattttttgtgttttttatagagacaggctttcaccatgttggtcaggctgttcttgaactcctgacctcaagtgatacaccctcctcggcctcccaaagtgctgggattacaggtgtgagccaccatacctgtcccagagaaatatgttttcaaaaaacaaacaaacatgaaatacgtggaaaggcagcataacatgggattatgtatggggccagatttacccttcacaagctgtgtgattttgggcaagttacttgaccactctgtgtcttgttttcctcacagtaatatgaagatagtcataggatttaccttataggatagttgtgaagattaagtgagttaatatacaaaggagttagaagatgtttggcaaataataaatggcatatatagtttattttaaaatattttaaaatagattgtcatgtaagagccagaaaggaaatgaggtcactcagagtggttcctcttttgatgtccccagggtgtcccacaaggacactgctaatctggggagttgaaaatcccacctgtcagaggctctctgttgccaccagctgcctggccatgacatcgcagagagaccatcttgcagcagtcagccccttggctaatcctctccaatgagaggttcagctgcacagcttggcacagcttggttctgggtccctcacatctctgtcttgtctgcaaaactaggctgtatagtctctgaaaacacagttttatctgctacctccttttctcctccagtgctgtatttggtgggttcccagtgatggctaatacccattcattggtctgataacatattttttcccctggtctgaagctggagaaaaaagcttcagcagagagaagccatctcctgttctgagatgactgctagttatcggacaagggaatgaaagatgtgttttgcacttcttaagcacagacttgcttttacaatatggggtgccttagcacctgccccatgttgtttgaccttcttgccaccttgaaaacctgccccctgccaagctgtggtgaatgctgactggcaggttcatagcgtcaaagtcacagtgctagtaaacacgtcaacgtgatttcacgtgaaaacagccatccaagctgttaatatgagcccgccttaagggattttgactttgcgcatgcctgcccttagtagaaagtacagcacatcttgctacctacttggaaatctgatggacagtcagaagctcctctggagtcctttggtgaatttcacaagagccatcaactctctacaatgatggggaatatttggggagttacatgcgcagttttctgggatgagggcacaattcagagtggtccaatttcagagtggttcatgcctcaaaaataagattgaggaaccgcagtttcacccttagaagaggctcaatggtatgggaaaaagccaaggagaaatcagcccttgaggtggagatgatgcctcagcttcacaaaaaaagggcaacctaataatctctttatctgtcctcctcctgcgttccttccccttctgttttctcctccagtggttattctttcctggtgttccctggtgattagcccatttccatgtacctctgactttctcttgcttgggaggcatttccccacttcctgaagactcagtggtgggtggtgtaggtcagctcttctccagccatcaaagtcttctcctcctctctctgctctttggatttgtattcctttacctctaaggactgttgggatggttgagattgactaaggggtggagagtaaaggagatgaagaaaccactcagattgagttaaaatgtccaagctaagactgggcacatggctcatgcctgtaatgccaggactttgggaggctgagttgggaggatcacttgatcccaggagtaccagacccgcctggcaacacagcgagacccccatctctgaaaaaaagtttaaaaattgccagacgtgctggtatgcacctgtagtcccaggttttcaggagtctgaggcaggaggattgtttgagcccaggagtcggaggctgcagtgagctatgatcatgccactgccttccagcctgggtgacagagtgagaccctgtctcaataaataaataaaataattttctaaaaacccaggccaccatttctcagagtatattaatccatatcgcattcaaaaaaaagaaagccttcttatagtattgagcacaagggagttttgtagttttgtagcctctcagttcatggggatagctctgtgtttgactaactctacggccttggccaattcacttcccctctcatggtctcagtgttcttgttactaatgtactagatggaacagactctacttcataggaatgaagaggggataaactgagataacagatacaatgaaatgagtactgtgtctggcacatagtaagcattgaataagtggtagtgactctgttagtgatgatgaagaagatgaagatgtaggaggaaggaatgaagaagagaagaagccaaaagcctagcacaggtctgatacataattctcaaaaagcagataatccaatagatagcaaaatgaatgatgagtggatgggtgggtagacggatgggtggatgatgagtgggtggatggatggatggtgtgttggtcatcaaatcagttttggaaagtctggatcaaacaagatccagcagttttttgttttgttttgttttgttttgttttcttctttacaggacttctcaggtgcttttatatgctaatagtcatcatgaattcccaagaggaagacagggcaagctgaatttctccaactcatttgtccgtggtgtcctttttacaatgagccatctgatgagccttctatccatgcaaagtatgccttgcaagatgccagtccagcacacttagcttctaaagagaaaataataggcagaaagctcaggtggttcagccagttcagcaactgaatggaattagtacaaaaatcctcatttaccagtcctggagacctgtgctgttaggagtggcctctgtgtccagctcctgtagggtcctggagcacagaaggcagaagatgtagagagtgcacaaagaaaagtccagcggagtagctgcatcctccccccttctgagaggcctcagggggtatttgtttgcctcaagcaaggtcaacaaattctcaaacccagttgtcattcatccccagacaggtcagaggtcggttcctgaggcattgttgatctcagcagagatgatgtgcagggttgatattcttagatttgctcattcagccagtcagtctggctttcagaggagaatcaggtcaggaagcgcttaatgaaccaagaggagcatggtgctgcctgaaccactggggatttgagtttgtaatgactatcagcaggctcctcacttacaaaacctactggaattttctttgtgcatctccataaccatttttagagatgtggttagtactgctggttagagtaacccagggtcctggattctttaagttacttctgatttaaaggtaccatcttcatcatccctaaaaaccataaattgaacttgatatcctttttactgttttggtttcaaaaattgcattttccatttacagaagccatatacctatcctttgttaattcctgggtcttagttttttgtttgggacatagaagaaggaggtaagctcttcaacaagaaggcacttcacaagttgcatttgttagcacgctttcatttgagcaattagcggttgaagggaggaagagttttgatatccctggcttgatcctccaaccagctgctaattctgttgtcactatgacaactatcaacagccatttactgagtgtttgctatgagcctctgagctaaacactgcagtatactgtacttatttaaatctctggaccactccatgtgttatggctactcgtgatattcttatttcgcagataataaatctgaggcacagagaggttaagtgatgtgcacgggaacacacagctgataactggtaggaactgggcttttaatgtggtctatgtggtttaatgtgagctcttaactactatactatggtgcttgcaacaagggagccaggcatggtaagaagttgccaggaggtgagagaatgtaatgccacaagaataacatatgcttagtacatacttgtcattctcataagaacttcccatggaacggctcatttgcatacactaactgaaagcagtctctaagtggggagatgtgacttctcttctccgggtgtctttttttgctagattagtcctccactgagatttccaatgggggtggttgtaatctggagagaggttggttgatggtctggtgtatcctgtccacagtctatggaagcttttcctatattcccatcttgataatttgatgcggttgtgacttgggtgtcacattgacaacccttttgtagccatcctctccttcactgggaattcatttgttagtccttggtattctaaatattatgtagcatctcagggaatttttcttgcggtccatgctaggtaatgcttttccatgttctcttctcacctacgctggatggagtttgagtgcatgtctggcagtgagtgtcatttctcagttctggttcaagctgataccctagtgtcatcattcttgatgactcagcaggtattacaggcatgtagggaaacctgactcttggtaactgaccaggcacacattctgttgtttaaccttggacaagtcacttggactccctgcgcctctgtctcatcccacaggtaacagatcattctcaaatacttattgagcaactactctgtgcccagtcctgggtgaatggcaggcaaacacagggattgaggaggtggtggaggggatagaatggaagcacacctgtgtgataatgccagctaggcctttaccatcccagggcaaatcactgctgatgtttcagaatctcagccccatagatcacgagtgctgggattggagcaggaggtagtgctgggaagacctggcatatgactgcttgtggaaggatgggatgtatatataagcagttttactggggggataatagaatggaagctcgaacagcaacatctgtatggggtgttggtggggcactgaagacagacagagctgccatgatgagcagagagatgaaaaaacaattttgaatgggtgcattgaaaacattctgaagaatgaattaaaattaactagcactttctggatgccttccaagcaccaggaacacccaccttcagcatgtcatttcactgctgtaatgcatttatgagagggtacaggtgttttgtaccatcttagccctgatgggagtagggctcaaggatgagtatatcgtccttaatcagaaacataaaagggcgacagagcccagatcccccagatccaaacccagcctctccaactttgaaacgcaggcttttcctactgttgtgatgccctcaggtcacttgtgatgaccttggaaacataggtagctctcagtggtctgggggcccctggcagcccctccaccttcctcacactttttcagtcagtcatttctggaaggatttgggaaaacttcatttgctagtggacattttagtcattgggtgagcaagaagaaatggcatacttccttatttgagccaatctgccttctcaaaagtgtgatcactattaaaagagtcatgatatggtgtgggcagtctctgaaccaaacacaatgctgaaatgactttcggacaaaggtgatggtgcacttagttctgtcttgggtggcagggacaactttgcagaagctgtcatggaacatttgacttaggccaacaagattgatctaaaaggaagaaaggaagagaggaaggaagggtatttctgcatagcaggcaagtttaaatggaaaagtggattcacagaggtatttggcaaagataatttgccagtgtggtttgaagaaaagagtgatctgtagaaaaacggaaaatttgtatcggaggatgaatttggacagggtaaagtgaggaatattatgaagggcctcagatgctgtaggaaattttccattacccacttttgtctggaaacaaagtgagtgattgtgtgagtaattacataatctgcacaaatctgtattttgaaataaacattgtcaatatccaaaagataagaaatgtgatgataggatcagggaaacactctgttttatgcattttgttttgttctgttttgatagtcaacaaatggcaactgacagcttctttttagatagctttttagaaagcaaagaatggttgggttgatcctacagtgagctcctgacctgtgggagaggcagctttttcgcagatatgattattggtacaaagaaatgtggctcaacatgcctagatcttccagtgtttcaagagatagcataaatctagattttatatgagatgcccccattaaacaatattacctttttttttttacactgtgcagacaaatcattatcatgatcatcatcatccccttctgtggactggacttggtccccacggctgcaggttgcgatgttgaccgacagaatccatgaggcaggagttggtcttctctagataccccctgtctctcatcttccagacacagccaacacttctgtttcttccttctctttcattgacgtctaaactttgagaggctaccactcagaagggccagtcacttatgttggctctctttgttagtctggtgtcaaactcctgggctcaagtgatcctgctgcctcagcctccagagtggcggagactcaggtgtgcaccactgtgcccagcttatgttagctgttaagatctgggaaaggaggttctgggcgcggtggctcatgcctgtaatcccagcactttgggaggctgcggcaggtagatcatgaggtcaggagttcaagacaatcctggccaacgtggtgaaaccctgtctctactaaaaatacaaaaattaggcaggtgtggtggcggatccctgtaatcccagctactcggcaggctgaagcagaagactagcttgaattcgggtggcagaggttgcagtgagctgagatcatgccattgcactctagcctgggacagagcgagactctgtctcaaaaaaaaaaaaaaaaaaaaaaagaagacctgggaagggagatgcagtatctgacagccagagctaaaatgcctttatctagaacaggaaaagaggagttaatacctaagaaggaaatgtcatcatggaaggtggagatagatggaagaattttttttttttttttttaggtggagggatgagattgaactatcaaagcctggctaagaaaaagcaaaatccttgatggaaatctctggcacagggaaaatgagcagaactggcaccaaggaagcattaggagagagaagaagatagtggggaagcagaaaggaacagcaaaggagcgagtatttgccattgtcttgaagtctgacttcttggataaaatacataccctagattaagggttagcaaaccatgggctgtgagcccaacctggaccattgcctgtttttgtataatcttcgaggtaagaatggtgtttgcatttataactggctggaaactttttttaaaaaaagaataatattttgtgacctgtaaaaatgataggaatttagtaaatacagtattacaggaacatggccacaatccttctttggtgtattgtcaacggatgctttttcacgctacaacagcagaattttgagcagttgcagcagagattgtaagttctgcaacacctaaaatatttattatctgagtgtttacagaaaaacatttaccattccctgcccgtgatgggcagagcagatggcaatacacggctctttatttgacttccgtatgtttcagggatctgcctgtttcttagccactaccagaactgccccactctcctttcaccttgctgtttcttccactatttaaagttcctgcattacaccgtgagcgtaataccacataatagatgttgagtagcccgacatttgccatgaaccatgtgcactgccactggggaatggaaagacacacgacatagtgtcgaccttctagaggaggctccaagaaggaagaatcacagctcagcaatactaggtgcttcccatttgggagagcagaacctatgttaagaaaaagaggttttgtttagtagttgttatttatttacaggctttatgattagtggaaggttttgaacgaggacgaagtcaatacaacttcaaaaacataagtaccgcaatcatacaggacaataatatataaatacaaaatcagaatcagagaatgtatgagtaatggtgatcgcgactggaggtgggagggacagcccttattttcacacaagataaggaagatatttgtaactcaagaacagcaaaaggttattgtatcatggcgttcttaagaagaaaacagaaaatatccccggcacaaggtataactatatatctctatcctgtatgtaatatatctcttatttctatcctactaaaatcagcagattcttttatatataagcatatatacacacagtcacgtgtcccttaacatttggcactgggtatgttctgagaaactggtcaggcaatcttgtactgaatactgtaggtgattgtatctaaacatagaaaaggtacagtaaagtataacattataatataatctgatgtgaccagcatgatatatccaatttgtcatggcctgaaatgccattatatatacagtcatccctcaatatggtgggagattggttccaggacctcccctcagataccaaaatctgcagatgctcagtccctgatataaaatggcctaggatttgcatataacctatgcacatcttcccgtatacatattaaatcgtctttagattacttctgaagcctaatacaatgtaaatgctgtgtaaatcattgttatactctattgtttaggaaataatgacaagaacaaacagtctgtatatgttcagtgcaggtgcagaggttttttttttttttttttttctgttttagatgatctgaggttggttgaatctatggatgtggaaccccagaatatggagagctctgtgtgtgtgtgtgtgtgtgtgtgtgtgtgtgtgtgtttgtgtgtgtgtgtgtagagagagagagagagagagagaaagttacataaatacaatggatcactatcttctctgcagtttccagctacctcttcctcaagtttgcttattgaagcattcttgattaagagtaaggggatatagttacctctcttctatgctcaggaaactaagagtctaaagctgtaaatttgttgcctgaatgatggaattaagtctcctgccttctggtccagtggtctttctattttacaacactaaagagacaatttgatctgacacaggccttacctaagtaagtaagagctctcccctcctgttgattgctaaaggaaagcagacgggagagacacgtccgtctcacagtgatgcttctgtcctccccggtaacttctcagaaatgtggtgttgaaagtcatcgtcaaaagctaaagttagaaacagtatcgggctgttgagtaagaggggtcagtgcgcagctgttatgggagctttttgaattgtacaacgtggccactttgatgcatgagaatcaattacagagaaaccttgtcaagatggccaaaattcagccttaaataattgaattctctgccaaaccctgtccgccgtcgttatctagaaatgcaattatgcagctaaatcaagcaactaaaattagtgtagtgtaaaaacaccttggctatctgaaagtggaggaattgacatttggatttagaaaacgccaatagttggatatgtttggcggtgtttgaagctctctcccagtttcaacaaaatctatatcaagtgtcctgtttagagtgagcagtggaatgtggccagtgaatgtttcattttgaaggtgattttcagtgattcctgggacttgggcattatttgagtggattcacttcatcagaacttcatattattgctttcaaaattgtggaactacacacacccacatgtctttctaataagaagattagaagactgacaatttgattgttatctgagccttcagtctcaggtcaaagccttcaatctgaaaccaaagatgtgtctgtaccaatcatcaggaaaacagggaatacatgataaaagtggctaatagctgccggtactgcacacatcatgttatggttctaggacttcatttaatgataacacagccttttgaagtagggactattattatctcagttttccaaatgagtgaacagggttcagagaggctaagtaacttgttcaagatcacacagctagtgattatactgacacccaagtcagtataattccaattatattaattaatatattaattcaattggaattaattccaattcatgtcatcccctaggaatttatctgctcctatgtaacatatcccaaatgattgcttgggtattttcaaacaccagaaagatttcaaatctgtgcttgaatgtattttttatccatagttttggtgcttgttagctatgccttgaaactctgagaacaagaagacatctcttgttaatgtattgcatattaatatatcacagatgaaagctcaaaataaagaatgtcgttaaaaacacaaaataaaaggcatagaaaatgttattacagactgaaatacagcagtgaaaacagtgttgtggttaggaatcgggctctggaatgtgtttgtagcttcgcactgccttgtacgagctatgtgaccatgagcaaaccatttaactagtatcagccctgtttcccatttgttatatgggactgataatagtactgacttcagagacttgttgtgagaatgaaattacataacacgtgtaaataatttaactctgtctctctgcgtagcacacattgtgcaaatacaagctggctggtagttttatcttatttacaaattgccactttaaatttgaaatcagagagagagcgggaggaaaactagactgaatatcttcttattttttttctatcagtgccaaacgttgcccacattaacctgctggatttgaattttaactcggaggcgataatcacattaatttacatttctcagtttatttttccctaaaaatcccatgtagaccccatcccttgctcttttggccaaattcagtaggatgagcttatatctcatagcctggttccctctgtcacttggtctcttggtctctctctctgtctctctctctctctgagaactaaattaatgaagagtatttggttagtcatgttaggcaagctgttcccaaaatagcaccttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 348 - DNA, 380590 bp, Homo sapiens
  source 1..380590: mol_type = genomic DNA
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 349 - DNA, 380590 bp, Homo sapiens; identical to SEQ ID NO: 348
  source 1..380590: mol_type = genomic DNA

SEQ ID NO: 350 - DNA, 380590 bp, Homo sapiens; identical to SEQ ID NO: 348
  source 1..380590: mol_type = genomic DNA

SEQ ID NO: 351 - DNA, 384633 bp, Homo sapiens
  source 1..384633: mol_type = genomic DNA
agctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggtgagcgcgcgcgcgcagggcaccttcccgggcccccgagggcagcgccgcgccagggaccccctctccgcgccctctgcgccctccgcgccctccgcaccctgggaccccgcgtctccggactcccggctccggaccctgctgcccgggactcccggatggacagtcctgccgttgccctgtccccaccctggtcccagacgggccgccgcggggcgcctcctgccctctcctgctctcaggcgcctctagagcgcccaggggcggcgtcgcgggagcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttgggcacccgcctgtggctgggagtttgcacctggggtacagaggcagggaggaaggcgggtgactctgtgggtaactagctggaggctgggccccccgggctgcctgacatacacctccttctgcttttgcaggggcttcgggaagcagggattccagtgccaaggtaggctctggggctttggggatgctatttgtgggaagagagggtgaaaaatactttatagaagaagttactgagttaggcagagagtgaaagaatcacgttggtcggagtgacctcccaggctaggaattcttcaccacaacagggtcctttcaaggggtgtgtgtgtgactggggccgatggcgcttgggagtcttacatgccaaggaagttcacctacccttcctgccttcccggctctggaagagtcaaagcggtctcctgaagcaatcctggcatggtcagttccgctgggggagaaagtgttttcccgggacgtttctgggagaacctgtcctccttagttcccctttctctgcccatgtcccttccttatctcacccagggaggttctgcctctccctgccttgcagaggtctctgcaggtggctgccgctcctctgcagatggtgcatcccctagaaaggcgactgtgtttgtcgcctgggcctcctctctctctgaaagaagtatttccagagggagtgtttctcagatcctggtttaaatcaccctatcttctgggttgaaacagaaaggtctccagggcactggttacctgagttcttgcatctggcttgagatcctggactctaaccaggggtatcaaacctgctggtggtgagttgatcacgtgtaaagtgtccccctcccccgtctttggggctcatgtctaaaagacagattgcaaattggctctccaggaccaaaagttacccgcagctctgtgtagcccttagggtgtcttacttgtgaatttgatgtgaacgttttagaactgggagatttcacatacacatcctaatttccaactttaactttgctgagaaatggtctcactttcgcttgaaaacaatcgtttggagctgagagccgtcgtcgtagatggggaacagccttaccattttgtctcagttgatcccagtggggaacacttcacccatttctggcccctgtgggcatttaagtttgcaacctctcatctggaaagtttgtgtgttatgttttctttttaatttaaattttaatttttcactcttgggcttggtaagattgagtttggtaagaaacggcacatttctggggtattgtatctttaggggcaaagtgaccaccaccctggtgagctgggtttaaatcaaaagaaagtatttgagtgtggaagagtctgacgtgatttagcactgactgacagttttgtggctgcacctccaccctccagggaaaagtaaagtgatccctagtgagtgtaggtggcatcgtcagtggtgcagaatgtttgcttgctggcagcatggcactgtgctcctctgagactcttgcatactcttctgagatcggggtcccggtgggctcagtgagccctgccaacctacccagcctgtcttaccaagatttggatcctctgcaccacaccagaggactcctcaagtctctttaagtggcaacaacttaggccctggtgcaaacaaatttggattgttttctagaactttgacccctcaaacaaaatgccaatggtgtcttggcaccggaatgtgtaatttcttctttgaggttgcctttcacttccatgaatcagtttcagtctttgtctcttgctgagatcgggggcgatttttaaacatttttaccacggatcttctatgccacctgctctgctgttattgatggatgggaaagtcactttggaatgtgcaaggcatgacacatttgaaataggagatcctttaactcaaagtctggaagataataggaattttctgatgttaagagaaaaaggcagaattaaagtttgtaatgaaatatgggcgctctagagataggagtgtcttttttttttttttgacagggtctcactcttttgccccggctggagtacagtggtatgatcagagctcactgcagcctcaaactcatgggctcaagtgatcctcctgcatcagcctcctgattaattgggactacaagtacgcaccaccatgcctggctaattttaaaacaacttttgtagagaaggggtcttgtgatgttgcaagactggtcttgaactcctggcttcaagcaaccctcccacctcagcccccaagtgttgggattataggtgtgagccactatgcccctctggagtgtctattttttaaattgcctttctttttctcttccctgcctccccaccaagaggcagcgtagagaagtgggcatttgcacaggctaccaggcaagtccctgtcggtctgaatcctagctttgagacttcccaggcatattacttagcctctctgtatttcagcctccttgtctataaaacggagtcagtaacagtaccatagtgtggctgagcagctccaactcattgcaatatccaagattcttggaccagagcttgacacagagtatgctcagaaaatatctgctcttatgattgtccccagactaccccaatggtggggcagctggcacgagagaagactggctctgcagggttgctttgctatggaactgcctgccaggtaagagtcaaaactcagccatgaacttctggtcactctgtgtagctgctttgacagcatattccatttgggcagcagtagggaggagtgaggggaggggcagattggcagtccctgaaattgagatgtttagaatgggaacatataggaaagagggaaatttatccctggtactcagcattgcctgggactaattctggaaccactgaggagttccttagtatctgattgttcttggtatcagatatttcctctgaaagtaaatccacttacgatggaatcaacagtttatacaaaacacataaggttttatgatctcacttaagtcagcaatccagagcccagggcctcaggttcctttgagttttctgctccactatccctggggagtgacaattatctcatggtccaaaaaggatgctagacgctggagtcctcacacccttctttcagctagcaggaaggaagaaaggggtaaagaagggcatatagcacatgctcggtgtcacttgtttaagttgctcaagatccttctacctacatcctcttagctagggtttaatcacatacccacaccttgctgtgagggagcatgtgggaaatgtagtgtttatttcaggcagccactatttagaggatgtttccatttcaaaaatacaagcagagagaggatgttgtctctgccactctggtaggaggtgtgtaggatgatcgcaaggcaaagaaaccattgagagtaaccttcaggctctattacattgtcatggaaattggggacactgctatgggttgggagaggaaggatggaaaactcataaaccttgggaaattatggatttctgtgtgctcaggggagcttaagaatagattttcttgctttcgtatgatgataggacgaaactctaggttgactgcctcataatttctccctttttgtttccactctgtctatttcttataaaaccactctctgggaggtaatttaagaatgtgtttgatgacagggaactggggctgaagatccctattgtaaaattgcctaaattctagagtagaagtggaactcctttgacaagcaaggcagatttctctctatggcatttttttctttgccttttatttatttatttatttattgagacagagtctcactctgttgcccaggctgcagtgcagtggcaccatttcgactcacggtaacctccatctcctggggctcaagcgattcttctgcctcagcctcccaggttgctgggattacgggggcctgccaccacgcctggctaatttttgtatttttagtagagatggggtttcatcattttggccaggctggtcttgaactcctgacctcaggtgatccacccgcctcggactcccaaagtgttcagattacaggcatgagctacagtgctggctgtttctgtggcattctttacaggaacttaggacctgcatttgagctttaattttaattaaagtcttctctaagaagatttttggtagagagaaaaaccttcttcttttattttaaattttgtttttagagacagggtctcactgtgtggcccaggctggagggcagtgacatgatcatagctcactgcagcctcaaactcctgggctcaagtgattctcctgcctcagtgtcctgagtagctgggactgcaggtgtgtgtcaccacggcccttttttttttttttttttttttttgagacggagtcttactctgtcatccaggctggagtgcagtgacgtgatcttagctcactgcaacctccacttcccaggttcaagtgattctcgtgcctcagcctcttgagtagctggaactacaggcacgtgccaccatgcccggctaatttttatatttttagtagaggtggggtttcgccacgttggttaggctggtctcgaactcctgacctcaggtgatctgcccgccttagcttcccaaagtgctaggattacaggtgtgagccactgaacctggccaaatacatattttttaattttaaaattttttgtagagatagtggatcttgctttgctgcctgtgcctggtctcaaactgccagcctcaagccaggagtctcattctgctttggcctcccaaagtgtttgttgtttttgtaaaggaagtgactttggtagaaatagagaggcaataaaatatagagattcagaattcttagcaatgagttggagtccagtagaattgggtatgtatctctgatggagccgcttactccctgtgtgaccttgggcaagtcgtcccccagcagcaactttggtctcctcatctgtaaaatggggataatagcacctaactcatagggttatggtgaagaataatgaggtggtgcatgagaaatagccacagcaagtatcaatgactctaagtgagaccatcagtattacttgattagctgtaggaaactgtgtcaaagtgggacggagttcattctggaacttgttaaatgactaggcctctttcatgtacttagatagtttctcttcttgggtatatttcttcctgggtattgggtaacaccagtgagtgctcagttcagtgtctgggcccagaaacccatgcctggttagcattgtcttttcttctgagaaagatctgaacttgccatggactctctagaaaaaccccagtgtacaaattttctatgaaaagctagaattgatgattataatgagtaagttggctcttccttttcccatgtagattagaaaacatgtttttaaatcttctaattgaaattattcttaaaaaaccccaaagtctgacatgactccaactattgttgttttcatcaatatcaatcctatcaaatcaaagtttattttagtgtgtaattaacacatgtagactagaaaagtttgcacttttttatatcacaaaaaaggttaattttattttctatggaaagctagaattgatgataatgagtaagtcagctcttctttttcccatgtagattagaaaacaggtttttaaatcttgtagttgaaattattcttaaaaaaccccaaatcatgacatgaatccaaccattcttgtttttatcaatattcaccctatcaaatataaagtttattttagtgggtaattaacatgtgtagattagcatagcatatgtgtatttatataacaaaaaatgaatcaaaagttaattttattttgggcagtgttccctagaaacttataatatggccccatgcacttcaggttgaattttcttagtaaaatcataaagaggtccattttttcaaaaaatcaccaagtcaggctgcaagtttagaggttacttctattgtttcacttctctttcttcccagaagcagaccccagagacctgtgagccaaactccactcaccttttagcttattctaaatgtgtcctgcgggcttctctgtgaataaaaggcagaggctttttgacttcgtgtttgatgatttggcttttttcttttttttaccacctgacgggggatttcaggctcaatgtcccaatcgaaataagaatctttgagtgggttaacattgagtcttaaaaaggagggctgatttgttggagaggcaacaacgaattcatttttcactgtagagcactcaggaggagtctgaagctttgtcactgggcaacagaatgcctttctaagtaaatatggaaaatatgacctttgaaaatctagctgatatgatatatagattcttaggatataatttttaaaaaatatattatttccaagcactaatgatactccagagatactgcccacaaccagatgcagcatgtttatagtgtatctaggccaaaaaaaaaaaaaaaaaaaaaaaaaaatagaagatacagaagaaggcaattggtcaaaagattaactgaaggtttgaaaataattttatacacatttgtactgttggggtctctcttctctctgtctctgcttatccttctgtctctgtctctttgtttccatcacacatgcacacacacacacgtgtatacacacacatatatgtaagtagatcaatatgttataattttcacaatacgcatcttcttttgctacttttcagatacaggtcattaaattactaagtataatttaaaatatatggtctggccttttaactctgcagttcaattaattcttgggtagatagggggatctgctgaaaagtttgtctctgacgccttcaaaggtaagtcccttatgttctggcatttgctctaataacatgaattctttgacttcattcatccaatctcttcattgaaattgtgtgaaattccatagatagaatgttagcctttttacagagaatacaacatccacagtgtttacatatggcatttggaggtgtgatggctgcttgaaaatccagtaggaaatttgtctattcaccacatacattcatttattcatccatccatccctccatttatccacccacctctctattcatcatccgtttttctgtttatctatttgtccatccatgcatccatcccttcactccattctccttctaaaagttcttttttttgagacggagtcttgctctgtcgcccaggctggagtgcagtggtgcaatctttggctaactgcaagctccacctcccaggttcacgccattctcctgcctcagcctcccgagtagctgggactacaggcgcccaccacctcgcccggctaattttttgtatttttagtagagatggggtttcaccatgttagccaggatggtatcgatctcctgacattgtgatcctcctgcctcggtctcccaaagtgctgagattataggcgtgagccaccgcgcccagtctcttttttttgtttagacaaactctcactctttcgcccaggctggagtgcagtagtacgatcttggttcactgtaacctccgcctcccaggttcaagtgattctcctgcctcagcctcccaagtagctgcgattacaggtgcccaccacctcgcccagctaatttttgtatttttagtagagacagggtttcaccatgctggccaggctggtctctaactcctgacctcaagtgatctgcccacctcaacctcccaaagtgctgggattacaggagtgagccaccacacctggcctcactgattaagttctatgtgtcaagttctatttgtcaggaactattttaggtgacagaatacaatggtgaatgaaactgagaaaatttctgttgtcatggagcttatgatgtagcggggggagataagacattctacagatcatttcactcatatttaacctcatttttattaggtactttgaagaaaatggactgggtaccgggagaatatataatgggaagctaacctatgtaatggctggggatgcagtcagtggtctgggaattaaaaaaaaaaagcccaacttctcattctcattttctgaggtaactggagaaagtctgagttgtcaaggaactagagctaaaaatctgtattgtaaaactgcccatatcctggataatatatgcaacagggctgaaggcagtggctcatgtctgtaatcacagcactccggaaggccaaggcaagaggattgcttgaggccaggagttcgagaccagcctgggcaacataacaagaccctatctcaattaaaaacaaaacaaaatatgtgcaggagacttatctttgtgacattctatggagaaaccgtaaatatttatttgtatcatggctgcaagtaagatgagtaagtatttggtagaactagcctgttaccttgagatggcttctttcccagtttgacagagaacttcatctcctcttagttaataactcagataatgagctgacttcctttttgtttagggtttacagtttgaggtggctgttctaaagaagaaaaatcagacaatttcagaggtggaggagcaagtctgggccaatagattgaaaataaataaaaagagagagcacggcatttcagtgagaggcattttgagctgaaagtcagttttcagggagcacaagattactcacattgcctgccaaataccttcctcaccctgtgtccatctctgatatattacaactcttcattcctttggcttaggcagtattttctcttgttcagaagatactttttaagtagtttaacaataaacagtgttgactcacttatagagaaaggacttttgtcaagtctgtctttctgatttcattaaggagaaagtctcagttggtgttaatatatctttaacaaccctctaacacaaatctgggcacttagtagatatctgttgaatattctttttttttaattataaaggaactacagggaattatgagaatgtaaaactatgggctgggtatggtggctcatgcctgtaatcccagcactttgggaggctgaggtgggtggatcatctgaggtcaggaattcgagaccagcctggccaacatggtgaaactccttcactactaaaaatacaaaaattagccaggtgtggtggcatgtgcttgtagtcccagcttctcgggaggctgaggcaggagaatcgcttgaacccgggaggcagaggttgcagtgagccaagattgcgccactgcactccagcctggcgacagagcgagactccgtctcaaaaaaaaaaaaaaaaaaaaaaaagttagtttctacctataaaccaacttttttttgagtcagcgagggtacacttttacctaatgttgagcctggttctgttctaccctgagcttgattctgtactggctattcctccttgtgaacagagaagggaagttcagtgtctttcctggaaatttttggtgttgtaaggatgctcagtgttcctgaaggttgagaggaacagcaaggacaggatctggtagagatgtcgcttttattcagaagtgctaagctgttaatcattaccatggttgttattaccttttaattgccatttgtcctgcttgtttgtggtctcctgggcatctccttccccctcagcccacaagcagaaagttgccctacagagtcaggaggagaactcaaacccagaccagagagctctgatccactcctatgggtcttggaactggctaagtagatggaaattaactgattcaagatatgcaacaccattagttcaaccatagctgtgttcctggggtgaattctagctttcttttttctttcatcttgctacttcccagagaccagactttgggcctctagggaaggagtatcaaattgggcttgagagttcaagctcaaaacagacctgattttaaatcttggttctgcttctccatatcttcatgacctttgggtgggtaaaatatgatcctgcctctatctatctatctatctatctatctatctatctatctatctatctatctatctatctgtccatctatctatctatccatccatccacctatccaccaatacatccatccgtctgtccatccatccatccatccatccatccatccatccatccatccacccagctattcttccattcattcatccaaacatccacccatccacccagctattcttccattcatccatccaaccatccatccatccatccatccatccgtctggctatccaaccgtttttccattcatttaatatatatttattggatgcctaccacatatcaggtactgttctaggcattggaactagaacagtgaacagaacagcatcgctggcttcatggaatttacattctagtagaataacagtaataagtgaataacatagaacgaatatattgtataatgtcaggttgccatatgggctttgaagagaagtaagacactgtcctcacccttaaagatcttcctggtcttttaaaaggagaacagcacatggccaattagttctgagacataatgtaaagtgctacaccaagaatgtaaaaacactttggatggcatccctactcctcctcggaccggtgaagattccacagaggaggtgacatttgggaacagtcttacagcaggagtgggagttcccggattgacaaggggatgagggcaggggagggtgtttcaggcacaggacaggacaacgcagttgagatagtgaggagagagaatagggcacatgcagggaacaggaagaagagggtgtgagggagggaggagcaggtgggaggtgaacgtcatatcagaggggttggcccctgtgaaggcagtgtagtgactaggaagtggttgttgtcactgttttaaagtgggatgtgtgggggtgagtgaaatggccaaatgtttgaaaaagaggagcatgagatgcctttggcaacaatacttgccatgactcaaatcctgaaattctaggcctgcagtgatggaagtcaggcaggagaaactgaaatggccatttagaagcagtgggggtgccttaccggagcacctcgtggctgttgctatttttcacaccctaaagagacatttggaatttcatgtcagtcatattgttgattgttctattttgagggtggttactagttatttttatggttctaacaatagggacatctctcttcactgtatccttagacgcggagggccgtagaaatgaattttcctctgaaaggcatcctcccactccctctccctctccactgctgtcacccagtgggtacgtgtttattgagcacatgctgcacatggtggtgaagagttggtgttttggagaaagaaaggcttcgatttaaatcttgacttcttgctgtgggaccttaagcaagttacttaacctcttcgagcttctgttttttcatagctaaaaggatataataataaaacctactttatgtgaagtgtttcttagcaccctacctgacatatatacagtaagcacttgataaatggtagctatttctgttcttcctaggactgggcactgtccttgtccttactgagtttataatcctgttggggaggcaagatgaatgctcttgaatcaaggagacgacgcaagaatggatgtgcttacatgtcgtggtcaatagcattagctgcaccttacagtggatcttagagagaaatgcttggttggggccggagaggtgatttgagtgtgagtgagcacagtgctttctgagaaaccctttcctggcctgcaacactttaatttgtgggaaacctcaggaagtagaattgcaatctgtgatcgccccatcggctgacctcacttcaaaaatgtattggtagcatttcaactttaaatagatttgtgaccatttcacccttctaaatttgggttcccttcaccctttgggtggagtgtttatatcccttttcggttgaagaagctgacagatagtgtaggtgaaggtggagggtgaagtctgaaggacggtcgcttgtctcattgggatagtcagggcagtgatttttgtgggatggccctatattgaagatcttctttccctccctaaaggtagagaccattctttagagtttagtgagtgctgcaaatgaagatttgatcgttatttggatttttttgcatgtgtatgtgtggattttttttggtagttatccagatacattttgtggcaaaatttatggctgagggtattgataattgtttctgagacaaacagtgcacttagggaaacaggattgacatatagagtagagaaggacttctttttatttcagttggatattcatcttttggtggctagctttttttaaaaaaactattaatattatttttgattgacaaatcataattgatggggtacaatgtgatgttttgatacatatatacaatgtgtcatggttaattcaaactaattaatataaccatcagcttgtttacttattttttatggtgagacatttgaaatttacttagttatttgaaatatatgatacacttattattgactatgttaccctgctgtgcaatagatctccaaacctattccccttgtctatctgaaactttgtatcctttgatcaacaactccttccctcatcccagattctggtaaccatcctcctactctctacttctatgactacgactttattagattccacatatacgtgagatcatgctgtatttgtctctgtgtttctggcttattttacttagcataatgtcctccagattcatgtatattgtcacaaatgatataatttctctcttttttttaaagtctgggtaggattctattgtgtgtatacaccatactttctttattcattcatcctctgttgaacacttaggttgattccctatctttgctattgtaagtagtactgcaacaaacatgggaatgcacatattctttgacatattgatttcagttgctttaaatatatgcccagaagtgggattacttaaaaaaaatttaatttaattttttttaatttgagactgagttttgctcttgttgcccaggctggagtacaatggtgcgatctcagctcactgcaacctccacctctcaggttcaagacattctcctgcctcggcctcccaagcagctgggattacgggcatgcaccaccacgcctggctaattttgtatttttgctagagacggggtttcactgtgttggtgaggctggtctcaaactcctgacctcaggtgatccacctgccttggccttccaaagtgctggaattacaggtgtcagccaccatgctcggtggtagttcacttttttgtttttttgagaaacttttagtactgtttttcataaggctatactaacttacattcccaccaacagtgtatgggtccccttttctctacatcttctccaacatgttattttttatctttttgataaaagccattctaacaggtgtgaggtgatatctcactgtggttttaatttgcatttccctagtgcttagtgtgctgaacattttttcaagtacctattggccatttgtgtgtcttcttttgagtaatttctgttcagatcccatttttaaatcaggttatttgtttacttgctattgagttgtttgagttctttgtatattttggatattaacttcttatcagatacagcatttgcaaatatttttcccattctgtgggctgtctcttcactttgttaattgtttcctttgctgtgaggaagctttcagtttgatgccctcccatttgtctccttttgcttttgcttaatcattgcccaaaccaatgttgtggagtttttcccttatgtttttctctagcagttttatagtttcaggttttaagtctttaatcaattttgagttgattgtgtatgtggtttgtaagataaaggtctaattgcattcttctacatgtggatatccagttttcccaacaccatttactgaagagactgtcctttccctcattgtgtgtttttggcacctttatcaaaaatcagttggctataaatgtgcaggtttatatctgggctttctatcctgttccattggttgatgcatctgtttttatgctagtaccgtgctgttttgattacaattgctttataatgtattttgaaattaagtcgtgtgattcctccagctttgttctttttgctcaatgttgtcttggctatttggggtcttttgtggtcccatatgaacttagggattgttttttctatttctgtgaaaaatgacattggaattttgataagaattgcactgaatctgtagattgctttggctagtatggacattttcacaatattaatttgtctagtccatgaacacggaatatcttttcatttatttgtgttttcctcagtttctttcatcagtgttgtatagttttcagtatacagatagtttgcttccttggatacatttacacctaagtaattttttttttgctgctattgtaaattagtttgttttcttaattttctggtctggtagtttgttattagataagctagtatataaaattagaataattagataatctaatatagaaacactactgattgtatgttggttttgcatcctgcagttttattgaatttgttgatcagttctaacagcttttttagtggattctttagggttttctgtatataaaatcaccttgtcaacaaatagagacaagttcacttcttcccttcctattaggatgccttttatttctttctctttcctaattactctggctgggacttccagtactctattgaaaagaaagggtgagagtgggcgtcctgatcttagaggaaaggctttcaacttttcagtgctgagaaggatgttagctacgggtttgtcataatagagcccatagtgtttattgtgttgagtgcatttcctttataccttattgctgagtacttttttcatgaaagaatgttaatttttttcaagtgcttttttttcctgcatctattgagatgatcatatgatttttatcctttattttgttaacatgggtatcacatttattgatttctatgtgttgaaccatccttgcatcccagggagaaatcccacttgatcatggtgaataaaattcttttaatgtgttcttcaatttggtttgctaatattttgttgaggatttttccatctatgttcatcagggatattggtttatagttttcttctcttgtgtttttgtttggctttggtatgatagtcttggataatgagtttagaaatactcccttaattttttggaagagtttaagaagaattgattgacatccagatcaagaaacagaacatgctggtaccctagaagcatcatctcacaatccctatcaaccgtatccttcaggagtaatcactatcctaacctctatcacctatgattactttcatctgttcctgaacttatgcccacttttctgttatgcaactccattgacttatgcccatttttctgttaaaaaatttaaaaagtgcagagctttaagttactgaggctgagcctgagaaatgttagctgggacttttttagttttgcatagaggaagtgaaatccgtatgggagacaggcaccttctggaatcacccattggggaatggtgccgtttgccttctttggggaacatctgcttcctgtttcaatgttgcccatcggttccagactgttcaacaaggaagccagggcattctgacagtttttccacacaataatttagctctgtaaatactaggaaaacttgagctcacaaactatttttagggcttaacatttcaaaaattctgtattagtaagaatctattaaagctgctgtaacagacaaaccttgaagtctctgtggcttgacagaagggagtttatttcttactcatgtcactaaccagtgcaggtggtcctggtcaggacatcttccacagagtcacacaggaccccagggtcctccccattgggccagtggaaggggaaagggaaattgagaaagcacactcatttcacaacaacttcagctggggaaggaagtcacatcacttctgctcacattctatttgccagaacccaggcaaagaggcaaccaacggaagggggtcctgggacatgtcgactagctctatgtccaggaggaaaagaaaacaggttttgatgaactcagtaaatctcactccagtctccaaagccataatttcctttgtctttctttgcggtgatgtatctagttttatctctcacttgactggtaaaactaagatgcaaaactctggacgtctttatcttatcaaacatagcagggaaagagtgagttctatttgtgttcctaaaagtgaaataaagaagcacttttcttgtttttagttattagaacaatctggctcttgtcagactttctagtttttcaatcagtcagaattcttgcctctctggttgcctgttgtattaatccattctcatgctgctaataaaggcataactgagactgggtaatttataaaggaaagaggtttaattgactcacaattcagcatggctggggaggcctcacaatcatggcagaaggcaaaggaaggtcaaggcacttcttacatggcagcaggcaagagagcgtgcacaggggaactgccctttataaaaccatcagatctcgtgagacttattcactatcacgagaacagcattagaaaacccacccccatgattccattaccttccgccaggtccttctcatgacacatggggattatgagagctacaattcaagatgagatttgggtggggacacagccaaaccatatcacctgtggacatcccaagcagatctctttgaggccgggttagttctcttctaagctgacttgttatatagaagaatcctttgttggttctacttccagatatttgactggacacccaacaaatcaattatctattgctggatagcacataacctcaaggcttagtggcttaaagtagccactgttttatttagttttagtttctgtgggtcagtaatttgggctgggctcagctgggtggtctgtctgatctgggcagggattggctgttcttggctgggctcatttaccttcctggggcctcagcagggatgtctaggacaactggggcctctcttcaggtctttcatcttccagtgggctatcctgagcatggtcatatgctgatgggtgcattctctgggcatgagcaagggctgcagggcttcttgaagccaaggctcagaacatgcataacatcacttctgccatattccctggtcaaagcaaatcacaagcccaccccagaagtaaaggaggaaatagagaagagaatagagatgcctcctcttgatgggagaagctgcaaataatttgtgatattttttggaacccaccacactaatttcagtgtggtcctcgcaattgcttggctgtctaaaaacatactccagtctagtgtgcatttctgaaaatgaacttgatcaaaggcaggccccaaatgagtgctcaacatttacacctgataataatactacctacctcctagggaaatggtagggccagatgagatgctgtatgcaaaggatacggccaggacttagtgcacacgcaacactgaatactaccaccatgactactgaatactgccatcaaatactaccgttactaccacttggcactccctaaaagcttgagattcagagaaaggaagacaaagcccctgtacttgaggagggagagaataaagagagccggcgggggagggggtggcaggagagagagagagagagaggcgtgtgagtgagttcttgcaacacagtgtggtcagtgtgatcacagagctgtgatggagtgcggatgaggtctgatgacttactggtcaagagcatgggttcaggcctcagttcctccccaatcacatgtggggtcttaggcatctttctttttaatcttcagtttctttgtctgtgaaatgaagataatggcacagagcctacctcccagagttctatgtggattaaatgagacaggcaaacaacaacaaaaaccacaaacaaacaaaaaacaaaaatgaaaacaaaaatcatgtgattgcttattaaatgttagttatagaaaaaaatataagttcttaaatgtgcccttgtaaaaatgtcctaaagacctcatctttatttagttcttctgcaactctggctagcatcattgataaattgtcttaaaagatgaagatttgtatgcaggtggtttattggggatgtagctcttgggaacaacatctataagggatagagggaagcagggaagaggtagttgaactgtggtgcaatagttgtaatagaggccaaagccaattccatggctggagctgagacggcccttcagaactgggacaagccaatgcatcaagtgggcattgattgtgggctgctctttggaaggcagcattaccttgggcaaagcagctcccttcttcaggggaggagtcccagggaggacacagctgtgagcaattggttttcccagcagctgggggaatgagtgccttgtccctatagatggttttgagggggctgcatttgggggaatgccttctggggttcactgcgtgcttctatgtctttcttagaggttcatttcaaactataccttggttcattcacagtactgatttagttactatccagattcatagactgtacttgctggcactggaatatcatggacagagagtcctaatctgactaggcctagggaatgacatgggaatagcttgtcctgggtcatccagctaccagagaggagagctgggattcatatccaaccaacgatactttatacctcacattacttctgttatgctacacactcctgagtcacaggagattccaacttgtatttcaagcccagactgcatgacttcaatgtcctgttgcccttaacccctgtatcagattgcagccccactctggaaagttttcttgaattcttctatgtatgttttttaaactgtgggtcatcactcattagaagttcatgaagtcaatataataggtcaagaataccatgaagaaagcagaacagaaaatatcacagtgcatcactctcaggaagggtagatattgtttcacgaaactttttttttttttgagacagggtctttgtctgtcgcacaggctggagtgcagtggtacaatcatagctgactgtatcctcaacctcccaggcccaagagatcctcccacctcattctcatgagtagctgggacttgaggcacatgccatcatgcctggctaatttctaaaactttttgtagagatagggtctccctatgttgctcgggctggtctcaaactcctgagctcaaacagtcctcctaccttggcttcccaaagtactgggattataggcatgagccactactcctggcctcatacaatttttatttgatataaacatatatagccatgagtgaactgggtcaaaatgtaaaatgtgtctcttactgcaggtaactgtcaatgtagttcgaatatcactgtgaaatatatagagaagaggctctgggggctcatgaacttggcccatggactgttgaggctttttttttaatctttagagatgatataaatgtagtgctttgaattctttataattagaagttttattcttaccccatcaccatgtcccaagataatttttattatcatctttcagctttaacatatcacagacaaaagttatttttccaaatagaattttaagtatggtataagaggtttttagaaatggaatgattggttttggcggaactgcctggcctgacctgtcactcgggtgaagtgtcagagagctgtgtcgaatgctggcggagaactgtccctctcctgcagagagaaggagctgcttatcctgggggataatgtgggttgagaaagaagtgttttatgagcagaatcagcacagagggagggaggaggaggtgtttaggggctgcagagagccgccagaagatgtgggaacagtatgccagcacggaggtgggtcagatccccatggtgggactctgctgagggttgcctccagccgagacttccaagggctgggattcagtgtgtgtttatgttctctggtgtgcctgataggtgggggcccacatgacagctggcctctctgtgtttcccttctggccgtctctgatttggggcccaagggccataggggggccagggcactccagatgggacgaaaagtcaagtccaagaaaaaaatgaaatccgggctaggcttgtccctgcttgaggatgtgagagagagagagagagtgtgtgtgtgtgtgtgggtgtgtgcgcacgtgcgtctgcagtccctagaaggatctctattcattggacagagaggccaagggaattttccatttcctggatgtcttcaaagatttcaaatgccattaacttgagctgacatttattgagtactcactcggtgactggcactgttctaagtactttacatgtattaacttatttaatcctcacaacagccctgtgtggctgctactgttattgttgccattttatgctgagaaaacagcacaaagaattgagaaatttttccaaagttacagttaggattcaaaaatagacttggttttaggattgtgtaacttcagaattgatggtgacaatgacgttgatgatgaggatgatgatgatgatgatgaaggcagctaatatttcagtgtctgcaatgagctgggcattttcacaaactttatccctttgaatctttaccttccactaagatttgctgctattcttatcccttttgtagataagaaagcaagcttagagaagataaaacatttgcttaagtaactgcagagcgtagattgaattcaggtccattcgagtcagactgtctgttcaccaaggtgaagggctccgggggtcacagaggagcaccatggtgaggaaggccccgtaagagtgtggcagaatggcaaccaggaaggatctggtatacgggatggtgataaggcccatctctcatggccaggaaagtgtgcctgccacagcaatgaatgaaactggcaacatttgacaggaaggggaaattctctagtgggaggaatacttccatcaaactgttttttttttttcccagtgggggagtttgcacatgtgtagatttttttagccatagccttgaataaggaattcagaaagtggcttctagtttgaggactttcattggccacgtgatcacagtaggctgatttcttcatgcctaagttaccaggctgggaggacaggctgagaactatgcaagctgttgagtcacttggaaggaagagggttacatacagcaggcactttcatggaataatacttccctgaagagctgcactaatttattgaggcactgagctggatgcttcacacacatgatctcattgaatgtccacagcaccctaggaggttgatctcattattaacttcatgaagtgactgaggcttagagatattaaatagcttccagcctgggaaacatagtgaaaccccatctctgcaaagaataaaaaaaaatgagctaggtgtggtggctcgtgcttatattcacagctacttaggaggctgaggtgggaggatcccttgagcttgtgagggttgaggctgtagtgagctttgatggcaccactgcactccagtctgggtgacagagtgagaccctctctctaaacaaacaaatcccaggagacattaattaacttgccactggtctctaagctaagtagttgaagagggcaacaaacccaggtggtctgactcctaggcttgaaggtccaggttcagctactccaccagtatccctggtcagtctttggccagggcacagaaggtggcatatcaagttgtggggtctgatttggaaagtgtgagatccctcctttgtatcttttccaaagtccactcagaagagagtagtgtaaaaggagtgatagcacagcgtggtctggctggcatagtcagccgccctgtgatgggcagggggaagctgctttctgtcctcaagcagcccctaaacttgtaggccagactcataaatcacacattgataactcagtgtgatgtgtgctgtaatggtggagaggggggagaaatgccaggagcagctcacctcccagggtcctggggaggctgcacagaggagcctgagttctcagttgggttttgaggcagaggaagcagtgaaagagagaggaagaatgtcagtgaggtgcggggagaagcaagagagagaagacacttggcaggaagaagtagttgaagtacccggggatgtttagcttgaagaatagaaaatttggaggaggcagagaaaaggcaggaaactttaaaagcaggagagaaagacctccaggttcccaaagggagcatggcacttctcaagggggtgaggttgacagcattaggagagagagagagagaaagagagagagagaaagagagagagcgagagagttgtcaaggaagggaaggacccatggaggggagagcacaggtgaaaatgagaagtgatgggaaaatgggtgggaaataaatgaagttttgaggccagttgagaaatcttgcttggtggtttctattttctttgtgaagcagaaaaaaagaggaattagacagacctgcattcaaatctcatgaccccaggcaaatttcttatccttagcttcttcattttgaaaaaggggtgaatgataataggacctacctaataagagttgtcaggatcaaatatgttagtgcttgtgtaagatgcagtggcaccctggcacttagtaccaaaaaaaagtactataaatgttgtcacctattgagggagtccgggtttgggtgcttgatacatagaaatatcatgaatagcagcagagaatacaagaagaagagaaagcttgggggagaagatagagaattatgcgttgggtatgttgaggatgaggtgcctgtgccatatccgggtgtaggtgcccaaaggcaactggaagtcatgagaagtcagggatagaggtaaatgtttgggagttgttaatacaggggtgcatttttaaaatatctgaagtatgttactggtggcactcaaagatttttaatgatgtaaggtattcaacaacatggaactacgtagttttaaaagaaattctcttgtaggccgcgtgtggtggctcacacctgtaatcccagcactttgagaggccaaggtgggtggatcacttgaggtcaggaattccagaccagcctggtgaacatggtgaaaccccatctctactaaaaaaaaaaagaaacaaaacaaatcaaaacaaaaaaaccgggcatggtggtgtgtgcctgtactcccagctactcgggaggctgaggcaggagaattgcttggacccggagtcagaggttgcagtgagccaagatcgcgctactgtactctagcctaggcaacagaatgagactcagtataaaaaagaaaaaaatgtttttttcttttaattcttcgggttaaggagagtgtcttagtttggtgctatcatgtcctaaacatctttctaatgcatgcaaatctcccttttaagctaaaagaatgaagcaatctcagactcagagctatgtacctgctagaatttaataatttaaattttcattgtgttcttcatactcaccttctatttatagcaagtgttactagctctccaattctggaggttgtttcagataggatgcattagttctttttttttttttgagacaaggtcttgctctgtcacccaggctggagtgcagtggcacaaacacagctcactgcagcctcaacctcccaggctcaagcaaacctcccacttcagcctcccaggtagctgggactacaggcatgtcccaccattcctagctaattattttattttttatagaaacagggtctcactgtgtttcccaggctggtcttgaatttgggctcaagcaatcctcacacctccgcctcctaaagtgctgggattacaggcatgagccaccatgcctgacctgctttggttcttaaaaacagaatatctggcgagcctaacaaggaggctggtggttccagggttggtttaatcaaagacttaacactgtcatcaagcgcctctcagttatttgctctgccatcctcaaaatgtgatcagtgtctcccttcttggtcccaggaaggctgtgatagctcccagaatcacatactcacagggcaaagcaggaaggaaggggacataggacaaaggatttgtgtttaagtatttcatgtcacatttgcatgtggtgcttggagctgtggcagctatgttttgaccatgagggacaaggttggcaagctgtaaatggcagtgtaaaaagagggagaggatctgtctccttcacaatatccttgagcccctgaattcactaatcttgatatagctctatctcttgaaattttgttttgttagataattctcttactgcttaaaacgtcttaagatgggttttctgttctttccagtagaatgcattgtatctcacacaatttgaggttattgcctcaacctactctgaatcattgctcctcccccttttttcctggttgattagcttctcttgagattgtgtcttatcttcctggttttttgtatgtcgggtaattttggattgtatcctggacactgtaagtgttgtgctgtggagactctggattcattcgtatttctctgaaaagcattgatgtttttgttttagtaggccattgacttggttggacagtagactgtctctgggacaccagctcagatgtcagttctgttttttattttatccttgagtcttctttgggactgccccatgcatgcatggttcaagagtcagccagacatttgggtggggtttagacacagaatttggggctcttctctcttggctgtctctattatggaattccttcctcactttccagaagccgtgagtgacctgaaacctgtcctctggttctgtacaccagaaagacttgaggcttcatgttgaagttttagctgacagcagcttgcgttcaggggaaaagctgtaaaatgaccattcccttcttccaagtttcaacctctctgcagaatctgctttcttttgttcactttcgagtaatttcaggaaaaaatttttttttcgttgagagtttttacttgttacctatggaaaggttgggtctagctgaagcttgcttgcccataacagaaacgagactcttttctgtctaacacatgggaaaactaacgcccagagaggtgaagtcatttccccaattgtcagaggcacttgagccagagtgactccatcttgagtaagggctaggaaaataagaccgggacttgctgggctgcattcccagaaagaaaggtattcctagcctctagatgtctacagttaagggaacagattgataatgtttactaaacagagccaggcttggcagtgtccagctatcccgatatcttgagaacaaaggcattcctaattttgctttaaggataataatattgattattgcaaaacagagtaattaagaaaattaatcctttatcacaaacccttgtagcagaacacatctctccatgatttttaaaatcatatatatatgatttatatatatgattatataatatataacatatatgatcatataatcatatatatgcatgtgtatgtgtatatatatacacatgcatatatatgtatatatgtgtatacatacatacgtatatatgtgtatatatacatacatatatatgtgtatatatatacatatatatacacatacacacacacacacacacacacacacacacgaatattttacctagggtggacgtgctccttctcttacttttaggaaccccctactctgtctatggagtaactgttctttcaccactttactttcttaataaacttgcttttgctttgcactgtggactcaccctgaattctttcttgtgcaagatccaagaaccctttcttggggtctggatcaggactcctttcctgtaatacaatgtcacagagctcttaagtggcagagcttggggccaaacttaggctgctgcacccgatgtcccagctcctctgccctatctagctgtggatttgtgcctcgaaatagaattgcattttgaatgcagtttcattttcgtatggaaagtgtctatcctgtaaatgtaactgtagcagccccaaagctgagctgggcagttttatggcagcctggagtcagtcttgtccgcttccaatcagggttcctggactggctcctatattaaaattggtattagtagacaatgttccaggcagagttttggatagaaactatccatcagcaccaagaatgtgcctgatttggtaatctttttaccaaagtaaaagtcagtagtaagttgtggttaaaagagaggaagttcagagttcagtacgttatttctctctctctctctctttgtttaaataaaagaggaagttactgctcttatttttgtaccagcccgtcagtaatgggtacagagtaaaatcttagctaagctgaggtcaaacttcaaaacttagtaataaggatctcccttgttcctttgtagggcgactaacatgaaggttctgactcttaacccatagagccacaaaaaatagtcctaggaaaatcatatgattttatttattttaggaacagaaatggtcccttccgaagtagaggcatttctacttctttcctaaacaccatctctgctcagtgagctctcccaccctcaggtactgtgtttcaggcttattgctgtattgctagaagtatcctcaccttcgagattaagaaaagatatttattgccgggcacagtggctcacgcctgcaatcccagtcttttgggaagctgagacgggaggatcacttgagcccaggatcttgagaccagccagggcagtatagtgagaactcatcttgaaaagaaaaatttattgagctcctactgtatactggggatacagcaataggcaagatagcccttgctcctcatgtaacctacagataataaacaagattacaaacaaacaaaataagaggtcgttctagattatgataagtgatggaaaagaaaaaacctgtatctacttcttatagcagagacctgcattgggagttgctgtgatcaaacaggaaacggaaggtggagtttgcttctgtatccctccatccctgagtggaggctgggtgcttctcacgaccagggcctctgagatttctttttttgttttttttaaattattttagattaagggagtacatgtgcagtttcgttacgtggttatggagcgtgatgctaaggttagggtttctattggtcgcgccactcacatagtgaacctagcatctgataggtagttttttgacccccttcccctatgccctctccctcttggggtccctagtgtcggttgtttccatctttatgcccctgtgtacccaatgtttagttcccacttcgaagtgagaacatgtggtatttggttttctgtttctgcattaatttgcttaggataatggcctccagctgcatccatgttgctgcaaaggacacaatccaaataagcacaatcagaaatgaccaagctgacattatgactgatcccacagaaacacaggagatcctcagggatgactatgaacacctctatgcacacaagttagaaaacctagaggaaatgggtaaatttcctttgcacacaacctcacaagattgaacgaggaagaaatagaaatcaagatttattttctgttttgtttgtgtgtgtgtgtgtgtgtgtgtgtgtgtggttttttgtttgtttgtttgttttttggacaggatctcattctgtcactcagactgaggtacagtagcacaatcacacctcactgcaaccctgacctcctgggctcaggtgatcctcccacctcagcctccagggcagctggaactacaggcatgtacaacaatgcccggcatatatatatatatatatatatatatatatatatatatatatatatatatatgtgtgtgtgtgtgtgtgtgtgtgtgtgtgtgtgtgtgtgtgtgtgtgtgtgtatatgtatatttaaatttttatatataaatatatatctatctttgtagaaatggggttttgccatgttgtgcaggctgaaattgagatttcctaatgtaagaaacagagccccaaggggctcttcttgggctggtcgctgtatttcatcaggtgcctctgtgttggacacttacttccctccattgcatagattggatcctttatgcttagcctagactctgccctttgggatgcaaggagctgagtgaaggttctgggagagtaggcttaagcccagaagagggaggcctctctctggatgtcatgctagagcctgccttttagtctttgtgtttccactctccatcctcctcttctggagttcagaaccccttcctggtcaaattgcccccgggctctatgggatcctgtgggattctatcctttgagtctaccccacccttcaagtacttcctgtcttttcacacctaagtgaaagaaagtaggataagaacagcagttgttaacttgattgattgtaaattgccttcattagaaaatgttaattatcgcccctgggaagggattaatcctttaggtctctaggttactagactggcaaaagccaagtgtgccttggttgactgtttctttctgagagtaaagagaaaacatcaggggaggtagaaacctcagtcatggggtaatcattatggccatgtttatccccatacacgtatcttctgctgattctggagtcagctagattttgtgacccagcatagatgatatagtgacattgtcctgctgtgttaaaaaatttaagttcataagaaatgcataagtacaatctcatcaggataaattacacaacatagataagattgaagaccttttaactcttttgacgtctcaatttagtcccctctaccttccccagaagcctattgtttgtaaatttggtgtctcttatagaactctgtagcattccaaagtctgaactttctcccatgcatatggccacttccctgttgatgaacatttagattcttttttggaggggttgtgtctattacaaacagcatggcaatgagcatctttctacacatctcatcaatatgcaagtgtttctcgtgttcctcggaagtataatggcttagccctggggtatacacgattcagcttttaataggttttgccaaatgttctccagaatagctggaccactgtatactcccaccagcagtgtgtgtttccgtctcactgcatctttcccagaccatgatattatcaggccttaacacttttgccaatctgatgggagaaaaatggcatttaattttaatgatcctttcctgtccccttctcttctcttctcttcccttcccttccccttcctttcttccttcccttccttcccttccttcccttccttcccttccttcccttccttccttccttccttccttccttccttccttccttccttccttccttccttctctctctctctctttctttctttctctttctttctttctctttctttctttcttttctttcttcatttcctttcctttctttcctttcttactttccgagtctcactctgtcgcccaggctggaatgccgtggcatgatctcagctcactgcaacctccgcctcccaggttcaagcgattctcctgccttagcctccttagtagctgggattactgccacctcacctggctgattttttttgtatttttagtagagacggggtttcgccatgttggccaggtgggtcttgaactcctgacctcaggtgatccaccggcctcggcctcccaaagtgctgggattacaggcgtgagccgctactcccagccacctcttcttactagtgagactgaacatctttttacatatttattggacaattgtatttcatcttctatgaatgtctccctccccacttttttataatttcatattgatttgtaataatttttatttcaatctactagacactgatcctttgctcgttgtttgtgtttgtgttgtctattttcatcaagtcctgggtcctgtgtcactttagtgccataagggaatgacagactcccttattattggtttagctcttgaagcctaacaaagtgtttccaaacagttcattattcccactttaaggatgtgaagactgaggctcagggtcacaacttgtgcaatcttgggtagactttgaatctctgagcagacttagaagtagaccaaactgctgtgagccacagggagattattattgctaacttttccctgttagccaaacacttctgcttggtccctctagagagaagtctttaattattcatctctttccaagtaattggcgacaagtcctgcagctgggagttggaataaacttggttgctaaaagcatccatcacacataaaacaggggagatctggctccaaagaatggtagatgtagatcttcccctacggatttgttttctgaagatctccttatacactgacctcagccttttgctgacctatccttgtgaactgaaggctgaaaaaaccaatgtagccatggtccacatccatttatcactttcagaaatggcccctgcactttatatttcttcaggtcctgcaaaaaatattgaaaatcctttacaaatagaggcaaggtcaggccatccctgtgggatttccagggagcagtgcactgacccgttttgcagaatgggaagcaaaaaataaaactcagacttagacagctggcataagcaaggacttccctattctgagtgccaaatgtcaatttgaaatacttgaacttttattctctgggacatgtactggcattagtaagaatttctatttattgagcatttatttggggcaggcagatgataagttatacacattaattatcttatttgattttcacaatgacctatcagttacataattgattgtctgcattttatggataaataacctgaggctcagttatttgacttgctcaaggtgatgtaacaagtaaatggcagagccatgatttaaataacaaaacgcatgctcttaatcaccacattaatgtcttgatatcaattaatagaaccatttcccctccattttctctttagtttcagaactggtaagagtttgtctaataagatttttataaagtggtgacatgaatggcttgtggggatggagactggggccggctgccaagggtacccatctcacacgaagcatcaggtccacttgggtttgtttttggctgattacaatcttgaatcaaacttttcagtacagctggtctcccaagaactttctaatgttgatttgagcttccctgaatgaatctcagaaaataagaaagggagagagaatgcctgtgtattgagcttgacccatttcacagatgccgaaatagaagtgaggcgacttgcccagggtccctgtggtggattgtgttgttgtctcaattatttgctcccacctcatacaaggattatacatttcacacatggctatgtgacatacatgtctacttgcagaagggacacactttccttcccactgatgtggagcattggccaatggaacgtgagcagacacaatctactctacatttaaacagaggctttgagaagctattgtgtggtttagccattgttcttcccacctctgccacaagaccaagaaagggctgttgcctcagctgcgtcctgggatggaaaagacacaggaagtagaatcacagagccacagacaactgcagtgacacgtagcacgagtaagagctaaacttcgaatattgtaagtcactagaattttggggttgcttattattgcacttacctaccaaaagctgactaatacagtcatatagccagtaacttgactaagctggagcttgagccaggtcgaactcccaatcctatccatggtctttttcttatttcagtcttccctaatattccattctaacttacatcatattttctgtgtctgtgtgctgtctgtccttttttcttttaaataaatctttttctaccaaagatatagaacaggaaataatatttttctttaaagagtctgttttttcatttcaacccatttattttgaaggaaattttatcatcgtataaatagaaaaacagtgtcatcacaaataattcataactataagcagtggctcacgcctgtaatcccagcactttgggaggctgaggtgggcggatcacctggggtcaggagtttgagaccagcctgaccaacatggtgacactccatctctactaaaaatacaaaaattagccaggcatgctggcagaggcctgtaatcccagctactcaggaggctgaagcaggagaatcgcttaaacctgggaggcggaggttgcggtgagccgagatcgcgccattgcactctagcctgggcgacagagtgagactccatctgaaaaaaaaaaaaagggtaatttaaacaatattatgaagttctagctaggtactgttggcagacaagaatctgattttgaaatatcgtctctctatgttccaaaaaggagtttggcaaatattagaatggtgttcaaaacatacaagcaccaaactgatactttctcctttgataaatcaggaagattaaaaaagaatcagaagaacaatttcttcctagtatggcttggtgtgatgagtgtcatctgtattccatataaaattctttcagatatcaccaatgagtgatatgttcattacaatggggggtgtccctttctttggttcatgtataataactggaaacatgtatatagcatgtggtatgtgccaggtactcttcaagatactttagttatttaatctattgtcagataaggaaacagaggcttggagaggctaaacaacttatcctagctagaaagaggcagaattggggcttcaagtcaggtctgtttgattccagaggcaacatcctaaagcaaagtttccttctaactgctcacttgggacttttaaacgaagccattaggtgcttcactttcttgtggcatgccagagtggtagctgcttcagggcatcagcctggggccacatcaggacctacctgcacgtaggttgatcaggaccctggcagggctgtcaggtacagccacaaagcaagctgtttctgactgtgttcccacactttctcaggcatccaccctggtgtatgaatttgcttcttctttataacaaactacctctaaactgcactctagtctacagatcagctgggcaatgctgttgatctcggctgggcttgctcgtgtgtctttggtcagctagcaggttatctggggcctgattggtctaggatggcttcacttgcacatctggcacttagatgtgtgttagctggagcaatagggggcctggaccccgtgggtctccttttccagcaggccacttgggcttgttcacagggcagatgggcccagttcaaagggtctgagaacacaacggtactgcaggatgagctttggaactgctgcaccgtctcttccactgcattctgcatacgggccctaaacaagtcccaagccttctcagattcaagacatgggggatgggctgtatctcttatggagagagtcacatagcaagggtgtggctctagggaggaatgaagagtggtcaagtgcagcctgccatgctggctccttcaccagcctgtcagttatatgagccaatgggctgaatcatagtcatctttctctccacatgcctggcccgtgaaggatttgcctgcccagcagagaccgtggaatgaatgtgtgctccaggcactctgccttctctctcttctttgacttctctaagctcgttcctgcccctgtccccctctgtctctcttccccaggatcatggcattagtcggatccttcccatcattttcattttagctccagtatcacctctttgagccttccctgactacccttccagcattctctaatcccatcaccttgttttttttatcttttctttttttttgagacggagtctcactgtgttgcccaggatgaagtgcaggggcacaatctcggctcactgcaacctgtgcctcctgggttcaggtgattctctggtttcagccacccgagtagttgtgattacaggcatgtgccaccatgcctggctaatttttgtatttttagtagagacagggtttcatcatgttggtctggctggtttcgaactcctgacctcaggcaatctgcccaactcagcctctcagcctcccaaagttatacaggttttttttttttttttttttttaaatcttttcatagcatctgtaactgtttaaaatattagtttgacttccttttctagaatgtaagctttgggagagcggggtccttgcctgtcttgttctctgttacttctccagctcccagaatggtggctggcactcagggggtgctcaacacacataattgtcaagaacatgctacatcaaggcctgagtggctttgccacggctcttcttgtgactgcaggccttggtgccagcagccaccccagttccaagaaatggtctcttgctggccaacttagcaggaagaactggcagcgttcctgttacagcacttccaggtggctgcttttccctgagtccatgtggcttctccatgtctctctgttggagtcacaagttgtggaaattcacttaggccaacttagaccaagaagtggaatagttaatagttaaatgtcagtctgggcaacatagcaagacttcgtctttacaaaaaatttttaaaaatattagctggtgcggtcgtgtgcacctgtagtcctacctactcggggggctgtggtgggaggatcgcttgagctcaggagttggaagctgcagtgaactatgattgtgccactgcactccagcctggatgacagagcaagaccctttatctaaaaaacaagaaaaaattaataaataaaagttaaatataaggtctctggaggtatcctgtttgggttcagattctggctctgccacttcctagttgggtcacttttgggaagttacttaacctctttgtgcctcagtttttcacctacaaaaatagagcaaagtgtaaaaatatgaactacctcacagggttgtcaggaaaactaaattttgtgtatggaaagcactgattgctgagcagatggtgagcatctctgagtaggagctcctgctgccattattattattattattattggaggttatcatgtgtgattgaagagcaggaacttcagctgggcttcaggagcaactggttagaaaaacggaagacttggcccggcgtggtgtctcatgcctgtaatcccagcactttgggaggtcgaggcgggcagatcatctgaggttaggagttcaagaccagcctgaccaacatggtgaaaccccgactctactaaaaataaaataaaaaataaaaaaaaaattagctgggtgtggtagcggatgcctgtaatcccagcattttgggaggtcgaggtgggtggatcaactgaggtcaggagtccaagaccaggctggccaacgtggctaaaccccgtctctactaaaaacacacacacacacacacacaaaaaaaaaaaaaaaaaaaagaaaaaaaaagttagctgagtgtggtggtgggcgcctgtaatcccagctacttgggaggagactgaggcaggagaattgcttgagcctgggaggtggaggttgcagtgagccgaaatcgtgccattgcactccagcctgggcgatggagtgaaactctgtcaaaaaaaaaaaagagagaaaaaagaaaaaaagaaaaatggaagacttatcgggaatgcaggcagctgtgcgatttcagcttctctttgtttttggaccatgggttttctggttcttctttggttcctgcaggtctgactttctcctttttctgttgatggtctttcttggcctgtgtttgcaatgggtcaaccatgtgctttctggccatacttcacacttacttcccaactgggacagatagcatttcttaagtctaattccaaacttctgggataatctgattgcccttcattgagtcagaagccagtggatagggacatggaagatgctatagctgggctccacccttgcaggtgagaggagcagtttcaggaaagtctgccaggcatgagctgagaccttaagagatgtcagctagaattagccactgtcagtatatctgcttctgggtcccactcttcatcctgcttttcaaggttttcaaatatacactcctactcagtctcatgaaaattattatttttaaaataccctttagcacatttacctctaatgatactagattcttgcctcctgcctctgtaaatcactcggtcacttcccgatcttatatttggctgtcaagaatgtggaaatctcacagaacccttgaatttcaaagttggaagggaaaattgcttgtctatgcttataaaaaatacacacctacacccacgtacacatgtatttactaaaatagtattaggctaaatattcagttgtacagctttctgatttcattaacaatgtctgtctttccgtgtcagaagagatagacatttgaaaaaacggcagcgtaggattttgttctatggatgagctaaaagttctttcacctgtccacaaacttccacctagtccgtgtgccttataaaacacaaattctgaaatcccatgtaacgtgtcagctagattctgcctatcactgagtagagatgaaccatcacatctcatgttctagatttggggttacaaattcaaattcctacaggggccaggcaactgtcttagatgtgtgaaacgtcctagatataagaaatgcctgtaaatgaaaccttaagagtttttataagcatacaaataagtatgtaatattttgaaacatacttattttttggtgtacccacacaggcctagcatcaccagattcttctctctttttttttttttttgttttgccccaagagaggcaggaaatgagtatatttatgggagctttcctaattgtgaagtgttggtaagttcattatttttaaaaaactaaaaaccaacttgcaggccaaacaaaatgtgggccaccaatgtgtaatcactgatgtagataatgcacttcaattaatctaaaatcatcaactattttggcagccctctcagactgctgactcactgagcttttcatctgatgaaatccttaagtgattcacaaatacttaatctgaaaacctcttaatctaacttgtgttcctggacttgtaaattgggtttctggaccttaatacttgctcatgttaaatccattctgttacttatgtttaaggtcctacatctgtcttccagcctgatcacccatcttttcagccatgtgttgtttttgaattcaactcatttgatcctttctctatgtcctttttttttttttttttgagacggggtcttgctctgttgcccaggctggagtgtggtagcacgatcaggactcaatgcaacctcgacttcctgggcttaagcgatcctcctgcctcagcccccacaagtggttgggactacaagcacgtgccaccacacctggctaatttttttgaattttagtagagatgaggtctcactatgttgcccaggctggtcttgaactcctgagctcaagtaatcctcccagctcagtctcccaaagtgctgggattacaagcgtgaaccaccatgcccagcctctctgtgtcttatgataaaaaaaatactggatgagacaagactgaggaggaagacccagggaccctttttagcagagcttaccagcgggtgtccaaggattgaatttcccttcctagacatgttttgcttcaactaaaaagatatatatatatatatatatatatatgatgtatatcacacacatatgtgtatatcacacacatatgtatgtatatcacacacatgtgtatatcaaacacatatgtatatcacacacatatgtatgtatatcacacacatatatgtatgtatatcacacatatatgtatgtatatcacacatatatatgtatgtatatcacacacatatatgtatgtatatcacacatatatatgtatgtatatcacacatatatatgtatgtatatcacacatatatgtatgtatatcacacatatatgtgtgtatatcacacatatatgtgtgtatatcatatatatatatgcatgacccatatttaaaagtaggatatttcataacgaaataccagtattaggtatcttttgaaaaagtgtcgtaactgacagcccaagtctgcattccttcatggcaccagggctagaactgagaagtagctgactttttggggtggatatgggctcccctagtcatgctatatgcctcattttatgtgactggccgggccccataggcgtttatgtttgccactcttttagaggtccctttaaggttgacatatattcattgattgatcaactcatttacacacgcatgcagtcattttttggacccctgtctatgtgctctgcacaatgcgaggtgtgggatataatggtgaccaagacagattccaaccactcactcacagatcccacagcctaccagggaagccagatatggaacaattatatacgtaattttacttgtaagtgccacaaagacaaattgtattaagtagtaccatgtggctgtggaagtttaacttgtcactaatccaccaaactctgagaagacagcatattttccgtcattcccaaaagactatcacaggcaacattgaggaatgctttgttaaactccagggatatattccacatcacacttcccccgtccaccagattagcaactgtccaaggacaaaacaaaacacacactaaaaaggaaatggggttagtccgatatgtctccatctccttatgctggttcttttgtctgcagaagccacggtttctttttctttttgaaaaaaaaaaatgacatttgcgtacctctctgcgtttctctttctccaggattcttctgggatcctaggcagtgtggtttggtgatctcactggtgagatctcttggagccctggaatgcaattcatctgggccagaagagttgaactaatttaaggacatctgagtgcttcactgatgtatttgttctgctctgtcccttcaaaataccactactcaaaacaatgttcagctggagaaagtggttaacactggaattttctttttttctgagacctaagtgacagggaagggtggatgaaggaaacatatcctttgaaaatcctttagttagaatcctttggttgcaagtaacataaatgaactctgattaatgtaagcaaaaaagaatttgttagaaggatatggggggggagggatggacagagatgtgaaggaaaagatgaagaaccaggctttagaaagtcctgaaaccaaatgaattctagggatctaggaagcagggactaatgactgtttccttcaggacaccagagatggggtgaataactctgtaaaagatgcaaatttcccacctgggtaacatagtgagaccctgtccttaaaaaaaaacagtagccaggcacagtgcctgtagtcccagctatgtggaggctgaggcagaaggatcacttaagcccaggagctcaagactgcagtgagctatgatggcactgctgcaccccagcctgggcagcagagggagaccctgtctcttaaaaaacaaatgctaaattttagagagaatagagagaatcttttcttaaaaaggtgctaagtctggggaaggagcttctgattgtcctgccttgagtcacacgaccatctctgacttgttgacccctctacaatcccatataagactccccaagagtagattctgagcaggtaaagcccatgggtgttcccaaaagtcggcctcaacctgaagccacttattcactctgagctcatcaccaatggcatgccgcactgtcaaaactctctttctgtgcatttgtctgggccactcaactcaggaaagttagttgttctgtgtgagtccccatgttctcactgatttcatttcagtctttaagctaaaaatctgtgtaaatggtaatggagaatggctacatcacacttagtatgtgtcaaagcagtatcctaagtgccttagtggtatcagcttatttaagactgacagtactctgaggtgcagtcacttctttttttttttttcctttttttcaaaacagagtctcactccgtcatccacactggagtgcagtggcatgatctcggctcaccgcaacctccgcctcccagggtcaggtgattctcatgcctcagcctcctgagtagttgggactacaggcatgcaccaccactcctggctaatttttgcatttttagtagagatggggtttcaccacgttggccaggccggtcttgaactcctgacctcaggtgatccacccacctgggcctcccaaagtgctgtaattacaggcgtgagccaccgcacccggcctgtcacttcttgtcattcacagtagttatgttctgtaaagtcactgcaaacactgaattaataaacactgaaccattgttcctaggtgaaatacaaagttgggttcctgtgagcctttggtcacagcattttcatccactgatcaacccgtaagcttattctgtgtgtgtttctgtttaaagacaccttaatatatattgttgactcattaacatctaactcactgccaacagcactccaactcgtgcctgatcaaagcttatataacacacgcatgacacatctcggactccttgcacttaggaacaccagatagcacttcaccattaccctatgggaccattttacagcaacgtcaccctcaaaaagcagaaaaatgggaaaaagcatgctgctaatataccacagagagaatgcttgtttacagcatgagagctgaagtctgaaggtagaacatggttttgttcatcctcagctgggaacacatgttggctgactcaaatattttgccactccgtacatgtccgtgagtgatcatgaaagaaccttgagtatggatttggcggttataaataaattttagcaagaggtgaatttgcaaataatgaggattgactataacccctgttattagctctagttaacagatgggggaatggaggtaaacagctctctgcaggtcttgcagccagggagtgtagaggaggctttgtcattctgggtgcacagcctgcgtccttaagaggcaatgtagtgttggctgggtgtggtggtggttcatgctgtaatcctagcactttgggaggctggggtgggtggattacttgaggttaggagttcaagaccaggctggccaacatggtgaaaccccgtctctactaaaaatacaaaaaaatcagtggggcgtggtggcacgcgcctgtaatcccagctactcaggaggttgaggcaggagaatcacttgaacttgggacgcggaggttgcagtgagctgagagcgtgtcactgcactccagcctgggcgacagaatgagactccatctcaaaaaaaaaaagaggcagtgtagtggttgagtgcagtgtagctcctgctgagagctggttttcatgttttgtgggcacacaggaagtagagaatgctgagagctgggcactgaagcagtaggagatatgggagtgggaaagtggttttctttagtaagtctgggctgttttcatagcctaggatgaagttcagcaatactcaaccttgaggttttccaggcaccttctccttgacatgaatctcctgcaaacagatgtcatagtaatctgggaataaacctttgttgttggtcctttagctatccttttttttttttttttttttttttttttttttttttgagacggagccccactgttgccaggagtgcagaagcatgatctcagctcactgcaacctccgcctccccagttcaagtgattctccagcctaggcctcccgagtagctgggattacaggcatgcaccaccatgcctggctaagttttgtatttttagtagagacggggtttcaccatgttggctaggctggtctcgagctcctgacctcaagtgatccgcccgcctcgacctttcaaagtgttgggattataggcgtgagccactgagcccggtgccctggtcctttagctttctaagacagcagcatagtagttcagagcataggctcttgggccatagcttcctgagttcgaatcctagctctgctgttttttaaactctgtgaccttgggcaagtcttaacctctctgtgcctcagttttcttgtctgcaaaatgggattaataaaaacaccgatctcataggattgttgtgaaaatcgagtgagtatgtttatagtgtttaggaaagttcctggtacacaagacatgctctgaaagtgtattaatattatttgtccttagactcagtagtactctgggggaatcgaatccccacccctaagccaggcagcatggtagaagctaggtcagctggcaggctcctgggtcttttccattctgctgcaggagatgcctgactcacctcttgtgctcacacagatgacagctaaatagaagggctctttcctcctagtattagcttaattataggggctccctagaacagtggggaaaatgagctttgagaatccccccaccacacacacaaggcccacactagcacctgaaagaggagtgaacattgcttcctgcctccttctccccctccttctcacatatgcctttgtctctgtgattctgcacgtttaatttttaatcccgggatgggttctattagtttttgtgtattttctctgccctggtttgagctccaaaaggtctgtttgggtctctgtgggtgtctgacagcctctgcaggcctttctgaattatataactcaagctttgtattttctatttgttactgggggttctttctgtgctataattttactcttagaaaatgaagtagggtactagaattttctctgggatcccctagggtttccttctgaatattttttcctgccatattttcttcgctaaaacatttttttttcttatttcagaagcaatacatcttcattatagaacattacaacaagatgcagagaaagaaaataatcttatcaagcagaaatgttaataccttgctatctacccatgtctctctgtctctgtctcctcaaacacacacaaatggggtcaagatgacataagagactatctgcttttcaattcacattttacgatctttttttttgtatggttctgtagtctccactgcttggcttgacgatctttaacaggtgccctccggatggtcatgggggtattttccatttctcactgttacaagcagtgctctgatgaaacaccttttgctggcattcctaattatgtcctgagagcagacttctagaagttttcagcagtgaggttaaagggaatgtttgcctctcctcttcactctgtgatgctcctgggggcccaggcccatgagtctctgtgtccatcttcccaagatgaaagacaaagaatgggcagagcattgacagggccctgtgttgactccttttctctcttttcccagtttttttttttttttttgagacagagtctcgctctgttgcccaggctgaagtgcggtggcgcggtcttggttcactgctacatttgcctcccaggttcaagcaattctcccgcctcagcctcccaagtagttgggattacaggcactcaccaccacacccagctaattttgtatttttaggagagacggggtttcatcatgttgcccaggctggtcttgaactcctagcctcaagtgatccactcaccttggcctcccaaagtgctgggattacaggcgtgagccactgcaccctggcccattcccgttttttaaaaaaatattttattccttttagactatttagccacagttttccattctattccttgggataagtgaaaacttgatttttaaaaaataattacaaaattttaaaatcatggtaaaaaacacataacataaaatttaccatcttaactatttttttaagtgtacagtatcattttaagtacatttacattgttgtgcaacagttaggacttttcatctcgtaaaactgaaactctatacccactggcaataacttcccatttcttcctccccaccgagcctctggtaaccaccattctgcttcctgtttctatgagtttggctattttagatgcctcatgtaagtggactcttgcagtatttgtcttttcatggctggtttcttcctttttttcttttcctttctttctttctttctttctttctttctttctttctttctttctttctttctttcttccttccttccttccttccttccttccttccttcttcctttcctttctttctttcctttttttttttttttgacagggtctccctgtttctcgcaggccaggctggagtgcagtggggcaatcacagctcatggcagccttgacctcctgtgctcaagggatcctcccatctcagcctcctgagtaactgggacttcaggcacacactaccatgcccggttaatttttttcttgatttttaatagagacaaggtcttgctatgttgcccagggttgtctcaaactcctggcctcaagagatcctcccatctcagcctcctgagtagctgggattacaggtgcacactaccatgcccagttaattttttttcttgatttttaatagagacaaggttcttgctatgttgcccaggctggtctcaaactcctggcctcaagtgatcctcccacctcagcctctcaaggtgaagggatgagcctcccaaagtgaaggcgtgagccattgctcctgggatgactggtttatttcacttagtgtaatgccctcagagttcattcatgttgtagcatatgtcagaattttcttcctctttaaggttgattaatattccattgtatgaataggcaacattttgcttatatattaatcggtcaatggacatttgagttgctttcacctcttggctattgtgaataatgctgttgtgaacatgggtatacaaatatcttttttttttttttttttgtagagatggggtctccctatgttggccaggcttgtctcaaactccttggcccaagcaatcctcctacctcagcctcccaaagtgctgagattacaggtgtgaactactgcacctggctgagactccacttccaattcttttggatatagatcctgaagtggaattgctgatggtagaaactgtctcgggaagatttttctggggatttggcttctaactgcaccacagctccagtggaaacatctattcattaaactggcatttattgaggaccagctttgttccagtcactgaacaaggctgggggcatagcgtggcttacataggtccccaccctccatggagctgatattcagcaagaagccagacaatacacaggtaagcaaattgaaaaaaacaggatgagatccactggcgataaatgtcatgatactgaatcaggatttgacaacagagtgatgtggtgagtggctactttagatcagaaaggccttcctaactgggtgacaggtgacctgagaactacaaggtggggaggagctagccacacagaatttgggaaaataccattctgggccctgggatgagcaatggaaaggtcttgaggaggaaagtggctaggcgtgatccttgttgctggggcgtggtgggtgtggggccagatcataaggggccccacaggatgagcctctgtgctaagtgcagtgggaagccactggagagttttaggtaggcgagatgcaaaggatcagatttgtatttaacacaccttccattggctgccaagtagagaatggattgttggggactggagcagaagtgggaggatgagtcaggagtcaattgcagatttctaggtgagagatggtgtctttgtctgcacgggcagcagtgcagagggagagacacaggcagatttgggaggtaaaaggacttactggtaaatgggatatgaattggaagagggaagcaaatgcacagctgggcacctggtacactttacatatgacgtctttgaacttcgtagcaatcccataaccacattttgtagatctgtgttgtccagtagaaatataacatgagccataaacctgagctgtgtatgtaatttaaaatgttcttagcaatcacattaaaatggtcaaaggaaacaggtgaaatgaactgtgagaatgttttctttaactcagcatattccaaatattcccatatcaacatgtaatcaatataaaattattaatgagatattttacttccccgcatagcaagtcttcaacatttgatatgtattttacacgtacagcacatctcaattcaaccacacttcaagtactcagtagccacatatggctagtggttaccatattggtagcacagttatagatgaggaaagagagtctcagagagtataagttcttatgcaagcttatagaattaggacttgaaccctaatttgactctggcacccgtgttgtgctcaaagcactgcatccacccccaatgatgaagacattttcaatgtaagcaaaagtcctggagatttccccacatcatatacatggggacataggaactaacatttgtcatatatttatattttcctttccaaagcagatcaaccccaagttaccttcccttagctctcgttttctgcctctctttgcaaatatcacttcattaaaaattgtgaacattctctttgccttcccttatgggcttcctgtttgaacaccacatccagggcaccctgggaactgaaccatctccttttctttttctttttgagtcagggtttcactctgtcgcctagactggaatgcagtggtgtgaccgtagctcactgcagcttcaatctcttggcctaaaacaatcctcccacctcagcctcctaagtagctgggactacaggaacacaccaccatgcctggctaatttttttatttttattttttgtagctgcaaggtctcactgtgttgcccagactggtctcaaactcctggactcaagcagtcctcccacctcagcctcccaaagtgctaggatgacaggtgtgagccacaatgcctagcccatatctccttttcttttgtggcattctagtagccctttggttcatgcgatcatttagttgttcagcaaatatggatgattgaatggatataataggtgcagggcactcccaggttctcaagatggatgatcttgggcaagttatttaatttctctggattttagtttccttgccagcaaactcaagataatagtaatgcctacttttaagtagttattgtgaagattataaggaattaacaataacgataataataagtaataatgatacatgttgtttattagagcctgctatatgccagacactaactctatgatttaaccttctcctgctaccctttactcttattatttctttaggagtgaaattcactaatcattaagctttttaactaactgaatcaattctgtttcttaagcagatgggagatcctgtggctttttaccactatccacagctctttttttctttttcttttcttttttgagacggagtcttgctctgtcacccaggctggagtgcagtggcatgatctcggctcactgcagtctccgcctccctagttcaagccattctcctgcctcagcctcccgagtagctgaggttataggcgcccgccaccacgcccagctaatttttgtatttttagtagagatggggtttcaccatcttggccaggctggtctcaaactcctgacctagtgatctacctgccttggcctcccaaagtgctgggattacaggcatgagccactgtgcctggcctatccacagctggtttcccctctttgcccccttttctggcattctcttctgattcactctcaactctgatttccaagctacccagctccttcccctagtgtgaatctgtatttgcactggatttatttttaaatgggaaatgaaagccactgtgtgctggaaaatatatatttcagacacgaggaagctggcggggaaatattttttggatgtctttctagatctcttaaaaatcctgtgagccatcaccaggttgatcttgtagtaaggtggccttggccttagtgtatttctttttgactcgatattgggcggcaggaggtttgaggattgtgatactaacaacattaacaacaacaaactttcattgattgattgccatgtgctggaaatgtgctaataaattacatttattttctctttgaatcctcaaaccaactctttgagacaagtgtgttgtattacagctgtagaaactgaggtcctaagaggtcagtagatttgctgaaggtcacagagctgagatccaaatctaagcatcacagcaagaagtatccttaaccatcatctttgctgttggttggcattagtctggctgtgctaagaaagtttcctttgacttgcagatggatcaaggcttttcttgagagaggcttctcttgcctggttctccttgattcttttactctaggagactcagttcttctcaaatccctgtctgtgggactttgggcaaaacattcaacgtcatctttacctcttagagtcactgcgagggttggactatggtgtgttaggtgttttttttttttttttttttttttttgatgaagtctcactctgtcgcccaggctggagtgcaatggcatgatcttggctcactgcaacctccgcctcctgggttcaaccgattcttctgcctcagcctcctgagtagctgggattacaggcacgcaccaccacgcctgactaatttttgtatttttagtagagacgaggtttcactatgttggccaggctggtctcgaactcctgacctcaagtgatcggcctgccttggcctcccgaagtgctgggattacaggcgtgagccaccgtgcccagccgtgttatgagttgaacagatttcttggcttcagcaggggctcagtatgggcctatcatcattttcatttatctccttttatgcctcatgctctatctgtccccttcatctctgcctgtagcagccacagaccctctctttccttggtgcatgtccctccttcccactttcctaatttcagcctgacttagttctctacctgtcagcttggacttaaggaaaggaagttctcttttcttggggggtcactggggccatgggcgtctttccactccatttcttttccaaagctgcctctggaacgaatctgtaaatcccagggcattgcatgagttttcttttctttctttccttctttctttctctctctttctttccttcttgctttcttgctttctttcttgctttcttgctttctgtcactgaaagcaaatattgtagacagatatgcttgtaggatagaaataaaatgccccattctttgaaacatattttgttttttattttagattcatggagtatgtgtgcaagtttgtcacatgggtatattgcgtgatgctgaggtttaggcaatgaacttgttacccaaatagtgagcatagtacccagtaggtagtttttaaaccgttacccccttctctccctcctttccgagttcccagtgtctgttgtttccatatttgtgtctgtgtataccccttgtttagcttccactataggtgagaacatgtggtatttggttttctgtttttctgtgataattcacttaggataatggccttcagctgcatccatgttgctgcaaaggacatgatttcattttttttatggctgtgtagtattccatagtgtatatgcaccacattttctttatccaatccattgttgatgggcacctaggtggattccatgtttttgctgttatggacagtgatgcaataaacatgagagtgaaggtgtctttttggtggaatgatgtgttttcctttgggtatatacccagtaatgggaatgctggattgaatggcaattctatttttagttctttgagaagtctctaaactgcttcccagaggggctgaactaatttacaatttcaccaacagtgtaagagcgtccttttttctccgtaatctcaccaaggcactgcataagctatctgagtggccagcaggcagaatgcttgaaggattctccagctgggggtgctgggcccaaaggctggcagctgtatggtcctggcctttttctctccagcagggtccccatgatcttcccaggtctagttttttcttgagcacacctgcatctgacagttaattgcaagaatctgacttgctgaactctcatttctccctcctcctttagcgcatcaagtccccttctttgttttcccagcttggttcttgcaaggactacctagaggaggacttcaggcaatccctttctccctggtgggctgctgtgttctcaccaataaatcaatgctctctctagtttcaggctgcctcttaggacagatgctgataccaagtgacttttgaggttgttgagttgagacacttggaccaaacagcggaaggcacagcttggctcagctaaaggaagctccgtgaaagctctctgagtgggcctattggctccatgagttggcaggctggccctcctctaggagatggtgggtcctcatgggctgtagcagggccaggccacaggagcagactgctggaggagaacatttagggccatcttccttgctgcctttctgtgatctcttcacccaggaagctgaatgctgttggcaagcaaaagggtgcttggtaaccatttcttttttaagtgtgtgctggtgccagggagggagaaatcctcaaaacccattgtgtctgactcaggcaccactggtttggccataaccgctagtttatcctccctccctctgccaccctcgtcatgtttctcgaccacaacctgtctggaccttccctgggttggccagggcttgataatctttttctgtaaggagttatcccttcctcatctgccaggatggggctactgtgcagggactgggtaacaggcttgaagttgcaagagggctggaagggtctcactagcaagcacacattatgtcttatataggtccctggccttgtgcttcagaccctatcacagcttttccacagctggggctgttgagaatgtaagtggtgacatagctggatggctaagatggggggagtatgagacctgcaagcgtgtgagtctccttttgctagcagagtgtgaatgaaatgtatttattttcccaataaattcgacatgactgatcattcatccacccacttacccacccatctactcactaacccacccactcagtcatctacacagctgttcactcgtccatccatccatccatccatccatccatccatccatccatccatccatccatccgtccatccacattcaatgtagtgtaatgattaagagcatagagtttggagttatcctgcttaggtttgaatcccagctctgccactcaccaagcatgtgatcttggttcagttttaaaacctctccttgtctcagtctcctcagctataaaatgagattgatgttgaaattaataacagagcctaccttacggcattataaaggttatgtgagtcagtatgtgtaaggtgctttcagtagtgcctgggtcatagcagtgctatctaagtgttagctattagcattatggcatctactcacctgtttatcatctataatagtcattaaaggtcttcaataaatatttctggtctttggccttgcaggccaatggtaggattgcactgcttgcctcccttgtgggtaggtggggccgtatgagtagctctgaccagtgagttgtgatccaaagtgatgtatgttcacttttatgctgggacatgtaattgctggttctagattatccagaaaaaatctttgagttatggctgctctatcaacttgctcctggagacatagaacttcttccttagctgatcaggcatgaggctgtagtatgtgagaaaaacaaacttttacctattttgagggttattactgcaggataacccagttctatctctgtctctctcatctatcatctatctatttacaataattccagtctcattttatttcccttcccttttctttttggcacctattactagctggcattttcttatattttttggagtttcctcccaaaatttatttgttattaattataagaatatgttttccatgagaaaaaggacttattcacttatctaattccaatagttagaatggtactttacacatagtagacactcagcacatatttttaaaacaataaatcagttaatgaatggatctacttgacttttagtaggtcctattgaacactgcattccacagctccttgaaaatccttactgaggcagctaatatttaagaaggaacaccctgacctttcactgtccagttttattgcctgaatcaagaaaaatatccctgagatagacctcactgcctctctgcaaacctcttaatacccttagtcaattgtaagaagctgcttggaaccctgtaagatggtctttggccagatcaagtcttgctcctcttcctctgaatcttgtaggggcctttaatctttctgtaactgtgattccccagaacaggatgcctttgttagcctagcatcttttctgttacttctatgaaacaaggagagacgctccctgggacccttaactatttctggaagcaaaatgacccttgccccactgaagacttaggagcctggtcacttccaaccgggcttttcatctttgtgactcccagtcatgggcaagaggctagctagctccaatcctaatgcccgtgccatcaactgcttcatttctggtttcttccttgcttttgtgataccctcattgactctttccactgtaccctgtggacttgcctctatgggacacttcctccccatcctgcctgaagaggaaagagcctgcctttcttctgggaacatcatcccattcagaaacaacaacctttctggagtcaggagtttgctttcctcttgttctttattgctgcttcctggagattgcattcttgtttaaaagctcacctgtaagactctgatcaaatgtccattcttccctctcacttcatccctgaagatgaatgggacatttatctttatatatgtatgtatgcctaggggaaaaaactgaaggaacattatgtatatatataatgcgtgtgtgtgtgtgtgtgtgtatatatataatgtgtgtgtatatatatatataattttttttgagacagggtcttgctagactggagtgcagtggagtgatcatggctcactgcagcctcgacctcctgggcttaagtgagcctcccaactcagcctccctagtagctaggactacaggcatgtgccaccatacccagctaattttaaaatttgtatttattattatttttggtagagatggggtctcactatgctgcctgcgctgttcttgaactcctgggctcaagcaatcctcctgtctcagcctcccaaagtgctggaaatacaggcatgagacactgcatccagtctatgatattcttatgtttttacaatgtgcttattattgagtagggaaattatgagtgatgtgtgtgtatgtatgtgtgtgtatacagatgtatgcatctgtgttcaatttttcctgttgagagtgagtaaacaaatatttttgaaaataataaaatacataaatgaggggcaggggctctcttggacacttccaaaagtactttgctcaattttctatgttaggcctatctgcaagaagcataagggtttgtcaggagctattatgattatttattctacaaatcccagttcaacaaagaagggtgaggcttgagtgttcaattagagaagctggccagttgtggtatcatatcagctctacatccaatgctcagttttcaaggggtcatgttgctctgaaaggcctggtgaggttgatgagtgtcttaatgaagccacttgtgaaagataatgtgacatgtttgtccatcacattgacgcaggaaaggagctttcacaaaagacagcacagaaattttgcaggctcggaccagaagggaatttgtcagtgtttagcttggctgacatcccacaccctaccttcttgtgcagttagaatcccttctagtgtaatgtgtgaaaaaccataggccccctgcccacaccctcctagagctgtatcaccaacagctttcaagtgtgtgcaaattgggagacggctggatcccacatctctgggtgacatttgctgaaacaaatgcctgttaataagtggcacgattcccttggtctcagtgataaagatgtacctgttactgggagcccttgagagaaatctttggtgaaggccttcacactcattttaattggtgatagacagatgtgttgagaaaacttacattttttttctccatccgtctcaattagaatgttatgaaatagcaccccctttgctcttcgtgctttatgccctagactttaaagactgacaacgagtggttaaaaaatctccattgcttcaggatgcagtatcagctgatttggtggattaaatcgttttaaggtcctgagctttaattcttacttcagtgattctcaaaccttgttttgcaaaaccccagagctttaatcttaagggatgagcctgctatttccaagacaacaaaattatttctacttcatattaatacaaaacattaaaatatacattgtctttgtaatatagtttattaattcaaagcacttgcattcccatttatctggtcttcatacaaaaccatgtatgagtgagtaggcagatggtcttatttattacttcgttcaatatatagatttttgagtgcctaccggtatacagcactgaacgaaagagaaaaatactagtttggatgggagctcaacacaatctgaggggatatattggacccattttgcagaggaagaaactttggttcaggaagggaaagtgaactctgaagtttgacataaagttagcttcagaactagaatatctgccttctgatctcagcctatcacctatctcaggttctgtctccacgataccatgtgattggaactggctcattaacctggggatggatcaatcagcatcttttttttttttttaacaggattggatggaaatctgcattccttgatcactcagtctatagggtgaacttacaatggccctcatgcttaatcttgaaatacagggatggtctgatggagtgtgctggagaccctgctgagatctttggacaactcctctccagtccactacctgaatcctttctcttctcctcaaaaaaatctgagactatccaaatgaagagtaaataaagggagaagtaagaaggaaacatgagacagagaggcagcaggagcagaatgaaacttggggagcagagggagaagccaagaaaacttactggacttggagccaataaattggccatggcatgaaggtttctgccagcaatatggcagcccattccagctctttccattttcttttcccagctgtgctgccaagcaccatgcttaggctggtttaacagagattatgctaggaggattttctaacattcatgtcctgattaccccttatctgattccttagcagtagccttcagtggcctcagagaattccaggttcagctgtctgaacagttcaatgactgtttgtaagttctgacttacgatcaaggcaggaaatgtgaaaagcatttttaaaaaggaaaaaaaccatccggcgttgttaacatttttgttattccagtattttcccatgcatataaatatgtgtacttcttttatttttcacaagagtactctcacaccataatattgttttataaccctcttttccactgtgctctagtgtaaacattttactgtaccaaatctttttccacaaaaggatttttaattactgcatagatttctattgaacggatgtactaaaatttacctaaacagctcttattattcaacatgattcaaccattgttacaaataatatagttgtatatttatctttatggaaagctatttctgaatactcctaaggataagttcatgtattagttaggttttgctgtgtaacaaatcatcgcacaacttagtggtgtcaaacaatgactatttacttacctctgcaggtctgcattttgggccaggtagttctgctggactaggctggaatcagtggacataggctctggttacttatgcatttgcaatcagctgggggactgcatgggatgatggtggtatgtcatcttccagcaggccaggttgtttccatagcagttagagttgcaagagcagcaaggaggcaaaccctgatgcacaaactttttttcaagttttggttgcatcacatttgcttctgtcccataggccaaagcatgtgacatggccaagcccggagacagtttgagaagacattaccaaaggcatggctacaaaaggcatgaaagtctcaggaccattgttgtaatcaactcatcacagtccccaaaatgggagtttctgggtcaaaaagtgtggccatttaaaggttttcattgtcacattgctctccagagaaattgtaactaatttacacaccacctagagtacatgcatttccaaattcacttgatcactggatataatcattggtttaatttccccccagaaaataatattattgcttttgaagagtacatgctttgtgagggaagctgtcttgaatgtccagcttccaggtgcaagcgcctgcatgtgtgcacaggtgacaccatgtagaaccgaagaaccacctggctgagtctagccaacccagagaattgtgagggaaaagaatatttttttaaggcagaagaaaaatgtatgttcattgtaaaaacctgaagcaatgtggtacctttatcatcaatatcttccccagtatttgattcattctgacattatgttgttgggttacatttatttctattacatttaggacctttgagtctatattcattagtgaaatttgtctgccatttactctttttttttggtttgctgtctttgacaagtttttgctattttcatcaaaacatctgggaagtcttccatcttttcttgttttttaatgcttaggaagagcataaatggcaaaggatttagaatattttttagaagtttgagtggatttaccatacccccaaagcaaaacaatttctgggcctggtgccttttccaagattagttatttgataattttttctggtgtatttcatgatcatttttggtatactttcaaatgtgttatgtttttttaagaataagcatttaattgagtctctaatttattagcataaaactatatatattgtcctgtaatgatgtgaaaaattgccttgccatctgcaattctcttttctcattcttactgagttcctatttttagtttttgaaaattttcttatgagctttgccagagtgtcactgttttatttttcccctcaaacaaccacctcttaaatttattcttcagttcaacttttttctgtttccagatgcattaatttctgctttttaattatttcctcagttttatcactcttcctagtttcttgagctaaatgtccctatgtactttcaattatatctactgatttgtcaaaaattggatagtatgctcgtctcctactatgatagtgatttttcaacacctttgtatttttttaaacaaattttgttttgtacatttctaatgtacttttatgttataggagttagagtttcatgattctccagtcttattgtgaagttactcagatctgagttcaaattctcctgtgctgcctaccaaatgatgaaccagttttagattctcctaaaagcttggtgataataatgccagtgttgcttatttttaatacttaaattaaatgatataattgatgttaagtgctcatcatagtgccaggcacatggaacacacactgctattggttatattgttattattgatgtactctttatgaatacaaaatatccatctttgtcctatgtaatatttttatgctttacattttatttgtctgataattaatatttctgctcatggcagcttttcccaccttttcattttcattttggatcattttattttcagcaagtctcatgggaaccatgtatatttgaattctattttttctttaaattatgaatctttgtcctttaatgggataattcaatccattcacattttttttttttgcaagacacagcatttggcaagtgtttacttctttcttctcccaatccactttcctgcctttgaagattttagaaccagaatttatgaaaaaaaataaatatatttgatttcccatgaattgctattgacacatgcattatttcatgcaattcaagacttttttaaagatgtgactctcaaacttacttcattactcactttttatgttttttggacccatttccctcttattgaattaattgattgattcattaattcaatcaacaaatatttattgaaaacatactgtatgcagacactgtgctagggtctgagagaaacgtatttgatgtaaacctggtctgtgtcttcactgaatctacatttagattcacaaaattagagacacaaaaatagatgacaaattaaagcagatataaaggaaaccaataagggtctcaaggagagattagtgaacgtgcatgtgagtatctatttagcaagtttaatgaggggatgctttttgtgaaggtgacatttatgctggcagcttaagaagtggcattagctgtgtgaagagaggaaggaagaaaggcattccaggcagaaggactagcatatgcaaagggcttgaaaggggaaagagccttatcctaatgttttcatagaaattatttttaaatactcaacaattagcttttgaattaaaggaatgcacacaagtgaagttaatctcttataggcaaaaccaaatgaaggattggaaaatgcctctgaagagtcagctggaaggctcttcatccatccatccaaccatccatccatccatccatccatccatccatccatccatccactcatccatccattcatccatccatccacccacccatctacccacccatccatccatccattcacccacccactcatccatctatccattcatccatccatccaataagcagtcattgagtgcctactgtgtgccagaccctgtgccaggtgttgatcacaaataatacaagcacctcctggagagtagagcctagttgtgtacatgggatggagggcccatgataataaagctggtacttctcatggagtgggatgggccaggggcatggggaaggcacacgtgctgtgctctgtagagctctgagcagggagggacgcagtgggaaagagctgagaacaattcctgccagatggctttattctttcccctgaaggaagtggggacttcgtgctgtgacatgatacacaagaacagtgtttcctgtgggtttgcaagggcattttgaatataaacactacagctcgctgatgtgtgaaaaaattattttttttgctttttcagactttgtgaagggataatcagatcaattttataagtctggaaaacaggtatttggggtgaattttaatgcacacattatagtggctggaaccctaaccaaaggcagctgtcacctgttggtgggttctcttaggcacgttgtttgttcatctagctgtcacctggcagcttatgccctccagttcctggaactgaccagttatctgcaactgactaagttctggtactggatcctgtgtgatttgactctaacctccaagaaccttactgtctttagctgtgaaatgcggagaagactggactacttgatctctcaacactctatatatctttaaagttaaatcatttgttcagtcatttgccctttcttctgccatttctctttccctctctcccatccatccatccatccacccatccacccacccatccatatatctatttaatatttatattatttatgttatttatttatttatttattttgcaatggagtcttgctctgttgtccaggctggagtgcaatggcgtgatctcggctcactgcaacctccgcctcccaggctcaagcgattcttctgcctcagcttcctgagtagctgggattacaggcacatgcaccaccatgcccggctaattttttttttttttttgagacagagtcttgctctgtcgcccaggccagagtgcagtggtgcgatctcggttcactgcaagctccgcctcccaggttcacgccattctcctgcctcagcctcccgagtagctggaactacaggcgcccaccaccacacctcgctaattttttgtatttttagtagagacagggtttcaccttgttagccaggatggtcttgatctcctgacctccagtgatccgcccatctcggcctcccaaagtgctgggattataggcgtgagccaccgcactggaccctgtctaatatttaattgagtgcctgttgtgtgctaagtactgtgctgggttctcatccagtggccagtaaattagacaatcctcccatcatagagcttgccatctagtagggagacagacaagcaaataattacacaggtaataatacaattacagttatgataagtattacaaatgagaagaatggggtaggtgagcatgtgtattaaggctatcggtctcattttgagggccagagaactctttcttgacaaaatgaagtttaaacaaaaactaggtgaagattggcagaaaagcatcccaggcagagggcacagccagtgtgaaggccttgggataggaaggggcatggccacatcaagggaggtaaaaatacataacaaaataataatatgagtaacaatggcaactactactgaaggaggaccgcctatttgccagggaccatgcgatccttaactgtgtggttttgatcaaatcatctaaactccttgcaccttggtctatgcatctataaaatggggtgatagtgatcgtgtatacttcatcaggttcttctgaggcgccaatgaagtaacgtctgggaaatccttaggtctatgcctggaccataggaagtgtttaagagacagccgttgtgactgttatttttatgaatggtattgggtgagaaaaagttcgtgttgcatctcagggcttgccttggaccctgttgatgatttctatgttgaggtcactcttggagtttctgcagaagtagaactcttggaagtctgctattcagcagatgagtgaaacaagtgcttctccctccgctcccacagaaagaggggcagagatgccagccacagcttggctttcaggcagcaggcacattgggatcagtgattggcatttgcaacattggttggcatcacagagagcatggaaggtcaaggtaataattatcaaggacagtttaagggaaacagtacattccattccttatccattgtaagaccagtacattccctgttctttaactcttgggaagacatctcccccagatctctctgctgaggatcagggccatttctctgttaaaaatgtcaaacagcaacttaccagaggaaacagaatggtggaaatgccatctcagcattcaagaagccccagtaccaaactttgcatgtatatacgtttgaaacaagctttgtaaattacttttgttcatttgtaattacttatccataagaactctctctctctctctctctctctctctctctctctctctctgtgtgtgtgtgtgtgtgtgtgtggtttgttgtcacctgggctggagtgcagtgatgcgaccatggctcactatattcaaaatcctgggctcatgcgatcctcccacctcagccttctgaggagctgggaccgtaggcacgtgccaccaggcccagcaaataaaatttatttatttatttatttatttatttatttatttatttatttatttatttatttattgtagagatagggccttgctatgttgctcaggctggtctcgaactcctggcctcaagtgatcctcctgtctcagcctcccaaagtgcagggattacagttaggtatggagagagaaggaaataaggaagacacagttattactctttaggacccataatttaactcaagtgattttgcccccaggtggtatttggcaatgtctggagacattttgtttgtcacaacttggggtggtgggggttgctactggaatctagtgggtagaggccagggatgctactgaacaaaatatacaagacagcctcacaacaaagaattgaccagtccacagtgtccacagtgccatggttgagaaaccttgatctaactgcttatgacataccacttccataaagccgagagatatcaattcttatgcagttatcactgtgtacaggaaattgtgtgtttgtacatgtgtgtgcatgaatgtgtagatataaagggataaaacctttatcttcctttcctaggtatttttacctctgtattatcaattgaaataatttgtttttgaatatacaatgcaaagtttgaaatcctacaggtacaacaaggtatacagtgaataaagaatctccccattccacttctgtcctcaagtcttcagttctctggaggagtactactgtcattagtctcctatatattagtagagagacattccgcatatgaaccttatacccttagtagcacctcacacatatttttttccttgttgcctttttttttcctatgtgatgacgtatcttagagatattttcatatcagcgcatatagagcagcctcattcattttaacagctgcacaggttttttttttttttttttttttttttttttttgtggctgtcccatacggtcttctgttgatgggcataggttatttctagtcttttgcataacaaacagtgctggagtggatctccttgtacctaactgtggacacacatgtgcaagtacgtctgtaatccaaaatcctgcaagaggaatttctaggttaagatggcatgtgcattttaaatttggctagagatttctgcagtgatgtctgatcctgtgcaccgtgcattcatcatgtgacccatttctagtccttcttgaccgccccctctcctatggggatcctgagctgatagggtcacttctgtctctcccccacactggaacagctctctctaatctacaagattaattttttttcctaatcaaaacacaattgccaaggatagtttgaaaaatattaattgtgtctgtcatcctggggctctgagcacgtgagcgtttgggatataatctttgcaaattgcctatagttcatacagcacagcaagagcctctctctctgcagccagtcctttatgatcgatcatacccaccccctctcccaatgggctgtatcctaagggtaagtagacagcatgggttctcttgcttaaaaaaaatcgttaactcaacgggggcgcctgctgcttgattgggagtatgtcggcatttagagcctgctggctgcaatctcactacgcagactggaagttgtggggtgtttttatcagcaggaaacagctttgagagcggaaggggagtgagagtagatggatagatgagggaattcgaagaggaggaagccgtgggagaaatgtcttcttttaaagacagacaaggcagatttctccagcccatctctctggaatgtcaagtaggaatgaaatgggaagttgggttaattctaccaggcctgcccagcaaccagcctgttcaggttccccaggagttgcagcctgttgtctgagactgtgaggttctcttccctgaagtgtcttgtgggaattggctggtggcagcattttctctgaggtcccaaaaattcgagtggtcaagaagacaccctgcaatgatcattccccaacattggaggccataaaagtcagtctgggtttgcaaatacacactggaagtctcagagctggtgcagacatctcagagctggtgcagacagacactgtggctgagtgtgtgtgccttgttcgttatggtttcactgctactggattggtacctggtacacagtaggcactgaaaaaatattcactgaaagaaagagaaaacttgatggcagttgtaggtctgggtctgttggaatttttacccccaggaagagatttgattttaactcaaagccagttgataaacagcctcacccagcagacagagggcagcttgggggaaactggagggtatgtagggtggggtggggctcttatctgtatggacaatgccatatattttctgaaacttggatttttctccttataagggagaagatccaagaagacaatgaaaaaacatttgcccctgcctttagaaaaaataaccttttaatttttggaataatttcagatttttagaaaagttgcaaaacatttacagagagttccactgcatacccctcacccaaagtttccccctaatgctaacatcttatgcaactgtgatgcctttgcccctaccattttgaggttaacaattaagttagtataatacttattctgtaccgagctctattctatatcattttcctgcagttgtttatttgaccctttcagcatcctttgaggaataagcactgttatagcagtccccattttacagacggggaagctgaggctcagctagactctagctagtgttcgaaacctaagttgtctggctccagtctctcacccctcaccattattatctgcacagtaatgatggtaactgtcatctcttgatgataatgcgttcaggaactgagctcaaaagtttttccctccctcccttcctcccttccttccttccttccttccttccttccttccttccttccttccttcctccctccctccctcccttccttccttccttcctttttttgagatagggtctcactctgtcacccagtctggagtgcagtgtcacgatcgtagttcactgtaaccttgaactactgggctcaagccatcctcccacctcaacttcttgagtagctttgactacaggcataagccatcatgtctacctaatttttagttttttcttttctttttttttttttttcctttttctgtagagacaaagtcttgctatgttgcatggctggtctcaaactcctggcctcaggagccctcctgcttcagcctccccaagttctgggattacaggtgtgagctgccacgcccagcctacttatgttatttctaaaccctcccctgactcagagctgtggtaaagagccccgcttttgttgtcctgctcaggacaaaaatacatggccccaggcttttgtgagtaggatccggaagggaacttaagtgtgtgtgtgtgtgtgtgtgtgtgtgcacccacgtgtgtgtgggggagtgatagagattctcctggtttctgtcctagttttttctaagcgtatggagacaggtctgctccgtacatctggggattggtattaccacatcatttcccccctaacagcagcaaagattctcaaagcttcatcagagcatgaacaatcagaaatgccttaattttgttagtcacaataaataatactttgattaattagcaagcacatgccttgggaatatgagaaagtaaatgatttctaccctagatctttcagatagctgggagggaagagagtattaaaatacgcttttaactatgggttttggatggagaagaggagaatgccggagaggggaaagcagcagtggaattgttcttggagataggagaaactgaaactctttccacccagggtctttgcagaaagtggttcccactgcctggaatactttttcttctctttacatggtgagctctcactctagtctcaacttaaatgtctccccctttgacaggcccttgctaacatcctgtttcaagttccttctggatattgattaggatggtaagcttcatgaggttaaggatctctgtttcatccactgctccatcctctggtgtctgcaacgacgctggcacaccataggcccttattaaatatgtgtcgactaaatgaatatgtggtcttattaaatatgtgtcgactaaatgaatatgtggtctatttcaagtcctcgtttgtgtctgccctagaacttagcactgtttgccattagcttgtctatttccttgtgaatagctagattccctcatgagctataagggccacgatggcagggggtgtgtctaccttgttcaccaagggtacccaggatgaacctggcctgcagctaagggggtgggctctagggtcagattacttgggctcaaatcccagatttcctatgttccagctgtgtgatttctgctaattgtcaagccactctgtgcctcattttccacataggtgcaagaggggtgataatagcatctatctcttggggttgttgaaagaattaaatatgtcagtattggctaaaacacttagaggaagctgggcgtggtggctcatgtctgtaatcccagcactttgggaggctgaggcaggtggattgcttgaggccaggagttcaagaccagcctggccaacatggcgaaaccccatctctactaaaaatacaaaaattagccagacatggttgtgggtgcctgtgatttcagctacttgggaggctgaggcagaagaatcgcttgaacccgggaagtgaaggttgcagtgagctgagatcgcactactgcactccagcctgggtgacagagcgagtcttcatctcaaaagaacaacaacaacaacaacaaaaaaccacaacacttagaagagtatctagcatatagtaagtgcttcagtgctttatacatgtcagttattggtagtactcaaaatatttgggatttaaaagttgggggatttttacataaaaggcacttttcctctttgagtggtaaaatctcccctaagaaagaggcaaggacagatggagatgatctgagaggcccaagagatccttaaaaccaggctttttaagaaatctgatgttttatttctccgtattgtcatggaaaaggccagcttttagcatgcctggtgtttctggtgttttcttctcttcactgttttctacatttctttctttgcattggtcctttttttttcttttttttttttttaataaaaaaaaaatagcacagctcggagtcttgcttgctgacttactgctagagtgtgggatccattgcttccatttagagaagcagccggccctggaatgtggccgcagggctgccaggctgactctgtgagctgagctggcgaggaatgcactttgcagcttgcactgagtttggccttacgtctgtggaatttcttctctcttcttactcattcgtgtcgttaaataaataacaacacaagcagtgcatcctcccggttataatggcaaacagtacaatgtgttacaacacacagtagcttgaagaggatatctctctcctgtggtagatgcttcattccccagaacttcactcctcacccccagaataggttgcccagttaacaggatgcctggttcagtctgcattttgggtaaacaaggaacacctttttagtataagtatgtcccaaatattgcatagcaccaacttatcctaaaacactatttgttgtttatgtgctattcaggtttaactgggcattctgtagttttatttgctaaatctgacaactccagagagtctcctagaaccagtttcctgtattttcttccagtaattttccaagcatgtgcaacctatggatatcttggcagacttactcctggtagaattcccatcacctagaacagtgcttaggacattgtaggtgcttaataaatatgggttgaatgagtgattgactctgtacccaccccatttttcttcacataagtggaaatatattatagtgttgtttcatatgtagcttttccttttaataatgtctcatggggattgatacatagagctgcctcatactcctctaagggtttcctagcattcccttttatgatgcataatgtatttaaccagtcccctgatgatcgacattggtgctgttgagagtctttagctattataaacaataaggtagtgagcattcctatatatgtttacctctgtgggtttgacgacgtgcaaggataggtgtcgcattggaatcatgaggacggaggatatgtgctttaaaatgtggattgatgttgctgaattgctttctgtacaggatctgttcacacttccctcagacagcttgttccccatctccttaccaacatagaatattatcaaactttttcattttgccaatctgatcagtgaaaaactagtatctcgctatcatcttaatttacatctctttgcttatgagaacatttttatgtttgaaagctctatttctttttctgtgaactgcttcttcttttttgcctatttttttctacttattgatttttaaccggtttttgtttgtgaaagaacatgtctgttagcctggcatatgttttatatataatgtaatttataaaattggtgtttaactttgaaaaagtgatttattatggattttttaaactctgtagacattaaaaaattcctcagtagtcaatttatgagtcttttcttccacatattctacattttgtgtcttgcttagaaaggcctcttactcaatgagattatagaggaattctcccatattttcttttactactttaacttctttttttttgcatttaaatctttaatccatctggaatttattttggttttaggagggaggtgaggatctagctttattttttaccagatggccagccagttgtcccaataccatttattgaataatccatcgcttcccacagaattgaaatgctgcctttatcatatattaaattgtggaggagggattttatactcattttctgacagcctccagtgccagctaggcagcaaggattttagggggtttcagctgactagaggcaaagatcctgacctgaaggataaccgcaatttattaaaccagaaatactctgtgtaggaacagtgggtttcctgggtggggacagggttggggtgggggaaagtgagtgtcccgtgctgggaggaatttagttacagcaagatttctcaaccttggcattattgacattggggggtggaataggtctttgttggagcctgtcccatgtagtgtaggatgtttagcagcatccttggtctctacccagtatacaccagtattaacttcaccctgatttgtaacaatcaaaaatgtctccaaacattgccctgggtggcaaaatcatcttcagttgagaattactgctttatcaagcctgggtcgagcagacctcccatccatttcttttaaacagaggcagggtcttgttccgttgcccatgcagtgcatgatgtgatcatagctcactgcagcctcaaattcctggctcaagccatcctcctgcctcagcctctggggaagctaggactataccacatgcccagctaattttttagtttttgtagagacagggtcttactatgttgcataggctggtctcaaactgctggccacaagcaatcctcttgcctaggcctcctgaagcactgggattatgggcgtgagccactgtgcccagcctgaacagaccgttgattagatgcatgtgaggccctttcttgttctgagagtctgtcatcagcagtatcaatggctccagatgtctgggaggcaggaagggaggtgcctatctatctcagagaccagaacacccagatttctggtatgagtgtggggtctgtggggaaagggtggaaccataccggtcgactccgggaggaacagaggttcccacctagccctacaggtgaatcttgcaaaactccctaggacctgcctgggagcctagccattccccctgctaaccacacccccagacaacaaggcctggccatggatccaggaacaatgactctgagaaccggaggtggcagatgttttgtgatttaacagcatatcggtttattgtcttatttttcttaggagtaaaagagtccatgggtgtattgttgggggcagcaggaagcacacgtgtctattcggagatttggggcagcaggtggggagagaaagtccatctagacgagggaggtgtgggagtgagatggaagaggagagggaagtgggtggaatccctgggagctgggggaaggaggaaaacacagagaggagctggctgaggtttgagcaaggcctctggagattggtgagagctggggcggcggggattctttatgacagtgctgcagagggaaaaaggattgttgctgagttgggtggaggtaggtaggagtgatttgaagaaggaggtccccttgggaagttgcattagtgggtgaatgggggttttataggccaggcagagaatatggggagggcaactccagcagatgaacagcttttgcaagacacctgtgtggagcatgtggcaccacctgagcgtcctccccaggtgcggctctaacacaggtgcaggttatgttgggagatagagagccagaactcaggagtgccttgggtgccttgctgtaagatttgggctttccctttatttctttttttttgagacggattctcgctctgtcgccccaggctggagtgcagtggcgccatctcggctcactgcaagctccgcctcccgggttcatgccattctccagcctcccgagtagctgggactacaggtgcccaccaccgtgcccagctaatttttttttttgtatttttagtagagacggggtttcaccgtgatctcgatctcctgacctcatgatccagccgcctcagcctcccaaagtgctgggattacaggcgtgagccaccgcgcccagcctgggctttccctttatttcaaaacactcctcacccactcaatatagaaaaccaaaaaatagaggtgagcaaaaggaagagagtgaagaacagcgtggtgtcacccacccagtggccacctccataaacgctgtccagtttcctctgcacgtccttagcatgctccctgcacacccactgggacaccagctttgtgaaggcaggggtttgttttgttttgtttacagagctaggcgaacagttggcactcagtaactgtgtaatgaatggatctgtactgcaaacctgatatcacttgctcttttcacttcgaagttcatgattcgcttccttgttagtagatacctttctgggacaggtttttaatgggcacaaattattggactgggtaaataggccacatttcacggaaccaacaccctcctgctttttatcagttttcttccacattcctctatcacaagtgctttcatttgtttgggctgctgtaaccatgggtggcttaagtgacggaaatgtattttctcacagttctggagctggaggtctgaggttcttggcgagaccctcctcttggcttatagataacctctttctccttgtattctcacgtggcagagagcagagagaggaaatcagctctctcatgtccctttttaaaaattcacatacatttaagttcaagtgcagttttattacatgggtatattgcatggtggtgaagtctgagctttttgagtaaccatcacccaaataatgtacattgtatctactaagtaatttctcatccctcaccctcttcccaccctcccaagtcactatcattccacactctatgtccgtgcacacacattataagctcccacttgtaagtgagaacatgcggtatttggctttctgtttctgagttgtttcagttaaaatattgacctctagttccttccacattgctgcaaaagatgcgatttcattccttttatggctgagtagtattctgtggtgtatatagaccacatttgcttcatccattttgagtcccttcttataagggccttgatcccattcagaaagtctccatgatctgatctaatctcatgatctaatcacctcccaaaggccccacctcctaaaagcaacacactggggggttaggcttcaaccaattaatctgtagaggacaaacacgttcagtccatagcaggaagcagtgccgccatggggaagagcattgtcgtgaaaccttttgcccctcttgttgagttttctcctccagcacaccctgaacatgctgacagtgtcaccttcctctttacttgtccctcttccgctccaagttgcctcctggcttcccagtgtctctgtgggcttgagaccagagcttgtcataagagatagatgacgtcacttgatggaaagagtcaagtgcagtgaccagcacatagaaggcggccatcaacattggtttcatcctttagagcaaagtttccccaagcgcctggtgtgcactggtgagatttggggacggggtggtacttaagacctggcactaattaacactagatcactgtgtgggaaacatagtcccttttctgttctcttcaaatccttctgatcgggctgaggagaaagcctcaggttggtgctgatgtgcttttttctcccagacccccatcctaacagaaacagagcaggtctcaggctcgggccgttaggcaatgatgtcaagccagaatgaactaacattattttgttctcgttgtgttttattttcatgggaaacttagagttatattcagagatattgatttttttaatcccatttaaaaataatgttttaattgagataaaattcatataatgtaaaattcacattttaaccatttaaaatgtacaattcagtggttttaaacatatttataatgttgtaagccatcaccactatttaattccagaacattctcatcacccccgaaagaaaccctgaaccccattagcagtcgctctccattttttttctctcttccctgcggcccctggtaaccaacaaactaattccgtttctgtagatttgcctatcctagacattttgtataaatagaatcatacaatgaatgatcctttgtgactggcttcttagaataatgttttcaaggctcatccaaggcatgtatcagtacctcattcctcttaatggttagatcactttccattgggtggatggaccatattttgtctatttattcatcaattagtgagcatttgagttgtttccactttttggctgttataaatagccataaacgtatatatgctttttttttttttttttttttttttgagacaaggtcacccaggctggagcgcagtggcacaatcacagctcattgcagccttgaactcccaggctcaagtgatcatcttccacctcagcttcccagatagctgggactacaggcatgtgccactatgcccaactgatttgtttattttttgtagacacagggtctcactttattgcccaggctgttcttcaactcctgagctcaagtgatccacccacctcggcctcccaaagtgctgggattacaggcatgcgctaccatgcctggtccaattttttgtataagcatgttttcaattctcttgggtgtcttcctaggagtggaattgctgggccctataagagctctgtgtttaacttttgcaggccatttcctgagtgactttaagttgaaaagtaagtcagtttaaagaaaactattaatcatattgcagatggtgtgtggacatgacaaacgtcataaacgtggtttgcagtgatggaagagtagaaatcctgcttggacatgacctcctccatcaactgtttcccactcacctttccagcctgtggtgcctctgttcccaggagcctcagtgcagccacgctggcctctgaactgtcttacatgagatgtccttcttcaaagatactgccgtttgtcttgtcctgggatatgcgcgacccacattttttttttttttttttttttttgagatggagtctcactgtttgcccgggctggagtgcagtggcaggatctcggctcactgcaacctccgccttctgggttcaggtgattctcctgcctcagcctcccgagtagctgggatttcaggtgcgcaccaccatgcccagctaagttttgtatttttagtagagacggagttttgccatgttagccacgctagtctcgaactcctgacctcaggtgatccacccacctccgcctcccaaagcgctgggattacagacatgagccactgtacctaactgcgccacccctttataccctccagggagctggacttttcagagatcatctttcacttagaatctaccgtttaacccttaattgcatttcccctcatattattatactcactaatgattttgttggagaatcttttgcctctgctataagccacttgagggtagcatctatattcaagtagtccattgttcctctcatagtgcagcctcacctgatcaatggtgaacagctgctgatgaacagaaccttccctggaggcccctgttctactgaatcttggtcagccccgtgtcctgatgcttgccctgcttgctgttactttttgcctgtggttttactgtttagttaacttcttcttttcctttctttctttcttctttttttttttttttttttttttgagacagagtctctctctgttgcccaggctggagtgcagtggcgtgatctaggctcactgcagtctccgcctcctgggttccagcgattctcctgcctcagcctccagagtagctgggattgcagacgtgtgccacctcacccggctaatttttgtatttttagtatagatggggtctcaccctgttgggcaggctggtctcgaactcctgacctcaggtgatccaccctctttggcctcccaaagggctgggattacaggtgtgagccaccgtgcctggcctttatttatttatttatttatttattttttgatatggagtcatgctctgttgcctaggctggagtgcagtggtgcaatcaaagctcactgcagcctcgaactcctgggctcaagttgtcctcctgcctcagcctcccaagtagctgggactacagatatgtgccaccacgcccagctaattgttgtattttttatagagactggtcttgaactcctgggcttaagcgatctgcccaccttgacctctccaaatgctgggattgcaggcaaatcagattgtttcacagacttcagaatggaggctgaggttcaaggaggtggacaccaggcagccctgggaggccatcttccatccagtatgtagagtaaggaacaggaaagcaggtgtaccgagaggcaagaaccatgaatatggacaaggagaagccgagagaacacaaggggagacccaactgtcttccagttcccagttctcttcctttccttcagccagaccgaccttcctcctattgggcccaaatcatgtcaaaaaaaaaaaatctgactggccaggcttagtcaaggaggggatcatagagtcccagtgccatgggtgagggaggcagtcagtgtagacatcatatcactggggagataagccttcaatggtgcccactattgggtgaaaaggcagacctggagctctgaacttcagcttccccttcttcccaaggttgtagaagtgggaaagccaagctagtcatttctgagtgcgggaggagaataatgtgacaaaaatggttaacatcagactagctagccttgaaagcttgagtctgaacggtgatatcttaggagaggggaaaaaataagcatgaagctgtggctctgctccatttctggggaaggaagctcttctgacttttctggctcagtgcaggaagggttgaagaatctcttaaaatctcctgagtcctctttgtccttcatctcagaattcctgtgcaggtgatgtttggctgtatgctccacgaaaggaatagggaacttggctccctccctccagggactgttgctgctcctctgagtttccttagcttaagctgtgccccctgtgtgccatttgccttgggacagagatggcccccattttccaatcctgttgtaggggtgggaatgctccccagtatgtgaaaatatccccaagctgtgttttttttttcttttcttttggggcaggctcttgtgttgcccaggctggagtgcagtagcacaatcatagctcactgcagcctcaaattcccaggctcaagcaatcttgcttcagcctcccgagttcctaagtagctgagactacaggcatgtgcctccctgcccagctaattttcattttattttattatttttgggatgaggtcttgttatgttgcccgggctcatgtcaaactcctggcctcaagtgatccttctgcctcagcttcctgaacagctgaaatatccctaggcttttaagcctcagttacttaatcaacacagtggggccagtacagcccatcattggcatttgtggatttggcagtggtggttccttttctcattagctacccagaagatccttagcacagcatcataagtcactgtcttgaaactccaccctgaattggatgcttggtgagcatctgggagaggcagaatggtgttggaaccaagattgtgggctctggagtgagatttctctgtaagtctggacaccaccccttggttgggtgatcttgggcaaattaattaatgtctctatgcctcattttccttgcccataagtgcggatgacatagcacccacctcacaaggctgttgggaggtttaaatgagttaagacctgcacagcccttagaacagggagctttcaatatgtgttggccacagctcttgtgcccaatcgatttcactcatttgggcaatgcctgggttctagatgaagggggaggaggctgcctgtagtgtcttcttcatgggccagtccagctctgcagtggactgtactggtgatgtccaccgtgcctcagcttttaagcatatattctccttgaaaactatttaagcagaacacactggggtcaagccagtccaagccagatgtttggggtcctgggtgcttctgttttctccatgtctgtttacctttaacaagatggatgggggctgtgaagcccctctgggcagccttttctggctgtgacatgcaccagaaacccacttttggcctgtttgcactgtgttagaaaacagcaggtgcagttggcagcctctcccctaccccttctcccgttagcccctgatctctggggactccttagactaatgcagttttaatgaatacacattactgtttacatgactgaaatgagaggctggctgcttattttatgctgaggtttacagccctgccttttaaaaccctctctcccttgctctgcttctggccatggcgatattttctggcggcccctatgctgtccctccaaataaggaattcaccatgaagtcctgcagcagtgtcagagccattgccttgccccggaaggagtgaactgtgtagaacaaaagcagaggctgggagctgtagttcacgcctgtaaccccagcacttcgggaggcagaggcagaaggattgcttgagcccaagaggtctagaccagccctgacaacacagtgggaccccagtctctataaaaaatacaaaatacaaaaatacaaaaattgatgacctgcacctgtagtcccagctactagtggacactgaagtaggatgattgcatgagcccaggaggtggaggctgcagtgagctttgattgcaccactgcattccagcctgggcaagagtgagactctctatcaaaaaaaaaaaaaaaaaaaaaaagcagaaagatggattctttatttttttaatttaaaaatactttttacaattcttaaatgcttgcttatgatagaacaattagaaaatgaaggtatacaaagagaagaaaataaaaatcacctctaattccactactcagaaaaaactcgatcgttaacattcctgtttatgttttagcatattttaatcaatctacatttatatgtattttaaattaaaattagaaaccaaacttaatacatgttattcagaaatctgctttttaccctacctcacaattaatatatgatgaatgtctttccgagttaagaaatatagatctgcagtatcttttctttaattttaattttaattttttagagacaggatcttgctcagttgcccaggctggagtgcagtggggtgatcacagctcactgcagcctcaatctcctgggctcaagcgattctcccacctcagcctgccgagtagctgggactacaggtgcatgccaccacatgtggctaattttttttttttttttttttttgagacgaggtcttactatgtagcccaggctggtcttgaactcctggccacaaacaagcagttctcccacctcagccttccaaagtgctgggattacaggcttgagcaccatgctcgatattgcagtatctttttttatgcatcattgtatcctattctataattgtttctatggtctcatttgtagaaaggttaacattaaatttcgaatagttatatgtactcactggttcaaaattaaaaaggcacaagagctttaatacttttattgaaagatttctctcctatccctagcccttaggccactctgttcacctcctttttggcacccaatattcaactaataataccaatttattgtgtatacttctggaaatagttcataatgtacatgcacatcatatacatttatttttctcttcctcaaacacgtacattcaaatgttagcttaccttgctttcttcacttcacaatatcctgtatcttggtgtttgttccatgtcagtgcatatagaacatcctcattcttttttttgaaacagagtctggctttgtcacccaggctggagtgcagtggtgtgatcttggctcactgcagcctctgcctcctgggctcaagcaatcctcctaccttagcctcctaagtagctgggactacaggcacacaccaccatgactggctgatttttgtatttttttttttcattgttgttggtagagacagggtttgtccctgttgcccaggctggtcttaaactcctgggctcaagtgatagggtcacctgggcctcccaaagtgttggggttacaagagtgagccactgcacccaatgtctcattctatttttatttatttattttttgagacagagtctcgctctgttgcccagaccggagtgcagtggtcttgggtcactgcaacctccactttccaggttcatgtgattcttccacctcagtttcctgactagctgggattacaggtgtgtgctaccacacccggctaatttttgtgtttttagtagagatagggttttgccatgttgcccgagctggtctcaaactcctgacttcagatgatccacctgcctcccaaagggttgggattactggcgtgagccaccacgcccggccacctcattctgttttatgattgcatcgtggtccatagtatgggcatccctggggtgtttccaaaattgggatatattgactcagaaacccttcctgtggttctgtccaagctccttgttcatatgacctggcctggggtgactggaggaaggatgtccattcggagattaggagggactgcagctctcgattatgaatgggattggcctccacaggcctgagtgacaaggacaaagcagagctggtgagccccatgccaggtggcggtcactggtggaaggccatttgtgacttctctgcagttctccagatggaccacatttaaaacagaggcactgccattcatttctacttggttgaggaaaggtttcatcgcaggcccagagagaggatcagatgttttttgcagtttctggcaagacattagtgggtatcagagggtaagtgatctcgtaaagctgactcaaagcaagagaaaatttcgtgtctgtcttagaaacacatttgcctccaaagggaaggcagggtgtggaggactaatcaacgcatttcacatttggtttctttgtctttcttggtgatcttacgtgactagccctgaatattttgcatatgtcaaggaaacatttcaaattactaagatgagaggaaaatatggggaatgaataaaatggggtttatcagcaagaacagcaaaagacttcttagagccggctggggattgttttgtgaatctctaaacaagaggggcagtttgacttggggatgggggatgttttgacacttggagggatgggagggagccaacaaagatgtaaagcaaaactgggatggtggtgatggagaagcagtgggggtttctatgggaagacataggaaataatggtctgtccttcacagagtaggtgaggtctactagaagatacttatcttttccctaaatttcagtcaacttcacatgattaagtttccattattaaagacttgttctttgtgttacctttttattattattattattattatttttttttttttgaaatagagtttcactctgtcacccaagttggagtgaattggcgtgatcttggctcactgcaacctccacctcctgggctcaagagattctcgtgcctcagccacccgagtagctgggactacaggcacacaccaccaggcctaactaatatttgtatttttagtagaggtggggtcttgccatgttggccaggctggtctcgaactcctgggctcaagtaatccacccgcctcggcctcccaaagtgctgggattacaggcatgaggcaccatgccaggccttttgtgttacttttgtaagagatgaaatgaaactaatatctaatcaaatctaagcatcaagcaattaaaaatattttcttaaataactattgagttaaataggactcaaaagtacaattgcagagaggctataaatgaaaaaaaatagagtgctatataaaacaatggataagatcagccaatgctgtgcttgcagataagttcatagctttaatacttttatgattaaggattgagatgacttgctttgagcataatctggctattcacttattctaaggaacttgtcatggctcaaacatgtttctagtatcctctttagaaattccgtttagatacagttttctttattaaaccttctaaggtgactatttcaaagatgaaacattcattttgttgtttaaattaacacgtattttttaaagggttatgtaaatgtgttatccatcaagtatatctttgagccttcatcacagtgtgatgtaagggatataagttgttaaggatccagcagtagagaaaatttctgcacaaaagtaactatagctctattacttttggaatattccctaggatacatccaaaaccaaatcaaattatactacttataaaacacatttggaaagatactatgtgaatatgctttgaatactgaggcttatgttagaacagagtcatggacgaatttgcaaaaaaaaaaaaacctccaaaatttcctggagtctgacaaaaataccggatagggttcctgaatatattttcatgatctttgctatataaccagatatctctatattttgaaatggatcatattttattagtttttcttagtacacaagcaacatgctatcattgcagatgccagaaagtaggatcacattgttgtgctatagatctccagaacttctttatcttgcaaaactcaaaaactctatcatttctcaaactcaaaactcaacaattctccattccctcttcctccaccccatggccaccaccattctactttgtctctatgaatttgaatactataggtatctcatataagtggaatcatccagtatttgtcatcttaagatttctttctttgtgtaacgttatcaaggttgatccacattgttgcgtgtgtcagaagttcccttctcttttaaaggctgaatatttcattgctttatagactgcacttttttatccattcatttgtcaatggacagttggattgctctcatcttttggctattgtgaataatgctgctatgaacaggagtgtacaaatatctcttcaaggccctgttttcaattcttttggctatgaacccagaagtggaattgctagattaaatggtaattctatttttaatttgttgagaaccaccatacttgttttcatagtggctgcaccattttgcattcccatcaacagtgcacaaggatttttccacatcctcaccagcacatgttattttctttttctttttttgatagtagccatttaatgggtatgaggtggtatctcattgtggtttttgatttgcattttgctaatgagtgatgctgagcatcttttcatgtgcttattggccatttatgtgtcttctttggagaaattctattcaagttgacttctatgattttgcattatcacatctgtattgattcaagcaagccaactagaataaattctggcatttaaaccgattttgtggtttttctgcaaataaattctgcccccaaataacctccaactttctggaagcagtcagcaggagtacagttctgaagataactttctttaaaaaaggaaattcataaaatatcatgcatcttccttttttgacactaatggaacaatttaatgtaatttcagagggaagcagagcccctggaaaggctggtgtgataagggaaggttacccagctttcctgtcaggcggtgtgtgggagcagagagtggcattctctgcatactcttggggagaagagtgggtgagacaggctgctcagggctggggcagagcccaggggaaggggatggaaggggaagaacagcccttcaagagtcctgcagaaattggtggaagttatttaacagaagtgttcggctccacccagcacattctgttgccttctacatacagagtgtgttagtctgttctcatgctgctaataaagacacacctgagaccaggtaatttataaaggaaagaggtttaatggactcacagttccacatggctggggaggcctcacgatcatggcagaaggcaaatgaggggcaaagtcacgtcttacatggtggcaggcaggagacagcatgtgcaggggaactcccatttatgaaaccgtcagatcacctgagatttattcactaccatgagaacagtatgggggaaaccacccccatgattcagttatttccacctagccccacccttgacatgcagggattattacaattcaaagtgagatttgggtggggccacagccaaaccatatcacagggtaatgaagaatgtgtgcccaagtagtagagggcttaagaaaaccactcttgggctctgagtctctctaggtctcagtttcctcatctttcaaatggcaatattaataagacccacctcatagggattgtgtggggtttaaatgagaaaagacaggtaaggtgctggtaccttataagtgattaagttgccattaaggtattggggacttagtgcttgtccttgaagagctttcggtctcgtgaggagacagcctgatcgttataaactattatagaaaatgggaagaaataagggttgaggtgtgataaagatgtgctaggccaggcaagatggctcacgtctgtaatcccagcactttgggattacaggtgggcagatcacttgaggccaggagttcaagatcagcctgaccaacatggcaaaaccctgtttctactaaaaatacaaaagttagctgggtgtggcggcacccatctgtcatcccagctacttgggaggctgaggcaggagaattgcttgaatctgagaggcagaggttgcagtgagccaaaattgcacaactgtactccagcaagactctgtcaaaaaaagaaaaaataaataaaaaaagatatgctataccctcatatcacaataatgccaggaaatagatcattaattctgaaccctaattcttgggtgggcatcaaggcaggcctcacaagaagaaggcatttgagttgaatcttataggctcagctgggttccaacagcaaagacttagggaaagggcagagcaggcaggggaacagtaagagcaaaggcttgaaggcatggaagttcatgggtaattactgactgagatgtttggtgttatggtgcatagaacactatcggatgataatgaaaacattgaattccagcatgtttagaaggacattggctgataaaaatgacgtcttaatagttatctgtggacaaatttgtaaatgtaaaagagttgtagactcaaatcctacagaaattaggcaggagacctaaatgagtgaagtgggtgggtataaaacagaggtggtggcaggaacccatgttgaattgaatagtgggtgttttgtttaaaggggcaccagtagtaatttttcctctgttggaatatgatcctagggctgccagctcttctactttttcaagagaagccagaaatctggatttcatgcaaaatttcttgtttttctttttattaaagacatggtatggaccaaaaaaagatgtctctaggctagatctctgcaacctctcatctatactctatttgcatttttaaagactatatgcaaatgttatttagcagagctacctagtttttttgtgtgatgatagcatgtgaaagagctatgatacatcttggaaatgtcaactttgaaatatacagtgactgtgttggtcactacagaatgatctctgcagaaacttcagttacattttctctaaatgacacctttgctttgacaacacattttcaaaaagaaaaatagcaaactacccttcctccagggccttagccacagtagctcctgccagcataacacaatgctgcaccttactgagggatcaggaaatgtggtttgatttataattatggcttcatgggtagaatggtggccaatgtccacatgagccacactcagtggctaagatccagagggcatttaatttaggtagccagtgttacagacatagtttagatttttgcagccttgaccaatcttaatagatctgtctgttctttagagttacctttttttcctgcctcctagctacctacaccttttaatgctaaatgtagttagctagtgaatgctgttatttgaatcttaaaatttcaggttgggacagaaccttaaaattcatgtatttcaaccaccctttgtatgaggcaggaatcttggttatgacaggtgacagaaaattcaaactagcttaattcagaagggaatttattgcctttataaaaccaaaaagtccaagggtagctgccttcaggtattgtctgatccaggggtttgttatgtttccaggacatggtttcctttattccatctctgcttatgtattggctcccttctcagatggaagagactcccctcatcaaggtgagatggctatggaagctctactcacatttcctctaggttcaagtccatgtagagaagagcacctctttctcttgttatatctcacaggctctaaattagctactagggccagtgaaaaagcaatgtgctgattgaccacccttatctactcttggagttccggatggaattaacactacctgaattatgtggaccaagagtgggaaaggaatagttctccagaaggatatttggtattgttattaaaataaggttaattgaatactcactgaaccatctaatgcttgaattcccttcatagcacgccattggtgactgtccaatcttcagttactaacatgctacccccaaaatggtgtgtttgtgcagctctaataatgacagggtttctcctaatactgagatgatattggcatctccatagttccagacattatttctggtcccaaccataatcaacctgttttgacacgggtgaacatgtaagggaagggattgctcattgtggtcacagaagtaacctacccaatagaagcacaccaacttgaagcatgcttccatgatcactgagggaggaaaatgattggcaagtctcgtattggtccttgaagcgctccctataaacacttgtcactgccaagcgtgtatcactggccaaagcaagtcacattgtgatatgattagactttgtgtccccacccaaatctcatcttgaattgtaatccccataatccccatgtgtctagggagagaactggtgggaggtgaatggatcataggggcagtttctcccatgctgttctcatgatactgagtgagttctcacaagagctgatggttttataaggggctcctcccccttcactcctcactcttctctctcccgtagccatgtgagaaggtccaagcttgcttccccttcgccttctgtcataattgtaagtttcctgaggcctccccaaccatgcggaactgtgagtcatttaaatctctttcctctagaaattacccagtctcgggtagtatcaagatagcagtgtgagaaccgactaatacgcatggccatgcctaacttcaaagcggctgggcaagtatcatattgctgtgtacttgggaggaggggagaatcagaatatttgatctggcgaccaccacacaactgaacttctctatttctgtgttcttcttgttaaccatctagtttctgtttcctcttgtgacacatatattaattaatttttcaatacccaaacacaagcctctaatatttatctttgtttagttacttcctaataaactaagatatctctacatcctgatcctaaaattcaaaggctccacgtataccatggtgactagttaattccaatatattgcatagttgaaaattgccaagagagtagattttaagtgttctcactacgaaaaaatgcatatgttaaatagcttgatttagccatttcactatgtatacatgtaggaaaacatcatgttgtacactacagatgtatacaatttttacttgtcaattataaacaacaacaacaaaactgcaaagtctccttagacccacccaatcacatgttgtctgctcatttaatgagtaaatgctatataggttcattctggacctgggtaaaatgatttacggactgggaccaagtgggaggaccctatttcaattcattaggtaaggtcttccaggtcaatatttgaccattgattggcacatctggggtatagttatttaactgccttctagtttacctcaatatgacccctcagtggagggaaaatggagcacaatgactagaagaatgttgagagatgaggaaagagagaatgggatggaaagaacataaaataggaaagcattgacattgtcacttcttggctatttcttcctgtaaaattttgcctggagtgccctacaatggggtccccatcctctgccctgataacatcttagtggatcactcctctctcccttttcattctgcaggacttgcccattggggctctttcagacctgactggtcattgggtatctgtggccatgataatcactctcttcctggacgtgaccctcctctcgttaaccaggatgcctgtgttcttaaggttggccgtttccaaggacagagagcttgcatcccatttctaggggactggggatccaaggactccattcttgacattgtcttgtcagccttgaagtgccgaaacccagcatccctgtctgaggtcatcctgtctctcttccaaacatgaggacttcttaaattttttaaaaaaagtttttacttgtataaattgagaaggcacaagtgcaattttgttacatggatatgttatttagtggtagaatctgtgcttttggtatgtccatcacccagatagggtaccctgtactcattaagtgatttcttatccttcactcccccacccaacccttccaagaaggatgactattactcaacagtcattcagtagccattggagaatgactattattccatactctgtgtctatgtgtattatatagttcccatttataactaagaatatgcattatttgactttctctttctgagttttttttttttaagataatggctttgggttccatcctgttgctgcaaaagacatgatttcagactgggcatggtggctcatgcctgtcatattagcacactgggaggctgacgaaggaagatcacttgagcccaggagtttgaaaccagcctgagcaacttggtgagactccggctctataaaaattaaattagccaggcatcgtgttgtgtacctgtggtcccagtttcttgagaggctgaggcaggaggatctcttgagcccaggagttcaaggctgcagtgagctatgatcacacaactgccccccagcctgggtgacagagtgagaccctgttttagtcaggacttcaagaccagccttgccaacatggtgaagccccatctctgcaaaaatacaaaaattagctgggcatgatggcgggtgcctgtagtcccagctactcaggaggccgaggtggaagaatcacttgaacccgggaggtggaggttgcagtgagccgagattgccccactgcactccagcctgggcgacagagtgagactgtttcaaaaaaaataaataataaataaataaataaaaataaaatcaaaggtcttactcttttttatggctgagtagtattctattgtgtgtatgtatatatagatatacatacatataccacacacatacgtgtatatatgtatatatatggtggtatgtgtgtctatatacacacaatgatatgtatattaatatatatgtatatataaatatatatacattttctttatccagtcatccattgattgatgcttaagttgattccatatctttgctattgtactgtgataaacgtatgagtgcaggcatcttttatataataatttcttctttggatagctgcccaaaattcaggtaaaagatctcagtctacaaggcagctcccaagcttcaaaaaattgtcctgccagatttttaaaagcaagttttctcaaaagcttcgatgtatacattggtcgatttatttatccattaaagtatttattgaatacttcttactgcgtatggtggtggtggtgctgaggtgtctcacagtgaacacaacaggcgtagcctctgctattaccaaaattattgtctggtaaagaatgcagatggctaaccaggcaggtgcctgtacggtgagatatgtgctgtgatggctgtaagcgcatggtgtgagcgtagagttgggtgcttaattgaaggcatcaggaaggcttccaggactaaatgatatcaaagtcccaccttaaggatgacaggtttaactaagtaaaggaggatgtggaaagaagggggagagtgctccaggcagaggaaatagtatatacaaaagcacaagaggattgaagaaccaaaatcactttggcatggctggaatgaagggcatgtttgtgtattttcagggtaggggatgtgtttagggacaagctcagagaaaaggaagtaaggaaccctgtcataaagggctcatctgtcctatgaaagagtgtgtacattttattctgagagtacagagccttttcttttttctaagcattacatgattagatttgtcttttagaaaccactctggctgccgttaaaaatgaatttcacagtgacaaggctggaggaaggatcttgggttaggaggcggtggtagtaatctaggcaggacttgaggacgcctgagtggtggtgaggaaggagagaggtggatggaagattcaagagatatttagggggtgttattgagagaacttagtgattgatttggcgtgggaggaatgagaaagtcagggatggctccctggtttctggcttgggtactaggtgcgctggtggtgcttttgacagagatagaaccatgggaggaggaacatgttttgagggaaggctgtctcccttttagacacctagttggtgtccaaatggcacagaccagttggcgtgtggatatcttggggcttagggcgtggatctgggctcagggtggagatctgagccttagctgcacatcagtagtcattgcagtcatggagtgtgctggggttttgccaagagctcatgtagattcaggcgagaagagaggaggggcccaggctgggaatactggctttggaaatactcttgaaatatatagaaatgaaagaatgtatagggctgtttccacagacgtttattttttatttttatttttttgagatggtgtttcactcttgttgcccaggctggagtgcaatggcatgatctcagctcactgcaacctccacctcccaggttcaagcaattctcctgcctcagcctactgagtagctgggattatagatgcccacgaccatgcccggctaatttttttgtatttttagtagagacacggtttcaccatgttggccaggctggtctcgaactcctgacctcaggtgatccacccaccttggcctcccaaagtgctgggattacaggcatgagccaccgcgcccggcccacagacatttactgagcaagagcttgtgcaaggcactctggtatgcatgcagtcggggaccctctgatgaatggaactcaggccttgtataaggaagtgacctccatcagagggtggagacgctgtcagtgaacatccatcacagacaagtgactgagctaggagctggggtaaggtagaaagaggaggacagtgggcgatatgagctgggaaatgcacctctgttgggggactggggagggcttcctggaggaggtgattttggtatctagtggttttgttttgttttgtttgttttttttgttttgagatggggccttgctcttgttgcccaggctggagtgcaatggcatgatctcggctcactgcaacctccgcctcccaggttcaagcgattctcctgcctcagcctcccaagtagctaggattacaggcgcccacaaccatacctggctaatttttgtatttttagtagagacggggttttgccatgttggccaggctgttcccgacctcctgacctcgtgatccgcccgcctcggcatcccaaagtgttgggattacaggcgtgagccactgcgccaggcctgtatccagtgtttaaggagatgttttgtcagataaagctggagttttgtaatggagttttggagatggggaagggcagactggcttaagagggtgctgcataagagatggctcagaggagagaaagtgtacgatgttttcaggacaaattagtccttcaccatggcaggaatctaggcggccgaaggacatttgtgggaaattgtagcagaaaatacgaggaggactttgatgccaggccacagagtttgcagtcctttttggagactcaggggagttattgaacaattagaaactaaaggctgatgtgacctccacaggatactggctaaacgcatgaactcttgaaccagatggacctggatttaagtctggattctgccatttccttgctgtgtggtcttaggcagattattaacctctctgagcctcagttttctcatctgtcaaataggagtgaaatacctcatagagggttgtgaagagtgaagtaaactaatgtggagaaggcattctgcagtgtctggaattcagcgacccctcagtacatgttaacacactaatactttctacgtaatcatacctgtaacaacacagagacgatggtattatctttacagcttgttcgcttctgtatcctgagcatctaggacagtgcctggcatgtaatggatgctggagaaatatttcttgggcaagaaatgaattgcaccagtttctttttgtaagggatctatttttttcttgtctggaaaaatactttgataaaaccttagggaaaagatgaaattccctttcttctggagcctagatttcaaagaggagaggttgagtgctctgcaaagtagaaggagaagattttgggcagtgaggaggagagaattgatgagatggtggggcacagcgtactatgaaatgtgactcttcccccgggacccccgaaaaaatcttctgtaacattttatatgtgtaagacatctctctaccatctgctatggtcgaaatgggatttgtagagagctcatgtgattctcaaacctcctagtaactctgcttacatggagagacagctgtctccaagccagctgttgtcttttggaaagctttaatctgggggaagataacaccttgagaaaagatgtcaggattggaggcagatgttgacggagccagtttctaatgccccaaggcagccacactttgtatggattgtatggatgggcaggtgcacaaggtgagttatttttttccctacccagaaatttatggaagcctggcatggtggctcacccctataatcccagcactttgggaggccaaggtgggcagatcacttgagcccaggagttcgaaaccagcctgggcaacatggtgaaaccctatctctactaaaaatacaaaaattagcctggtatgggggtatgcacctgtagtctcagctactcaggaggctgaggtgggagaactacttggacccaggaggtcgaggcttcagtgaaccatgttcatgccaccacacttcagcctgggtgagagagtgagaacctgtctaaaaaaaaatatgaagttgctcttttgaagagcattctaatgacttatctggagattctaggaaagaaattaaattcagctttcaatgtctgtctttctagatttcttccttctaacgttattgttgttatgtcctcaaacaaaaacatttagtacttattatgagcttcatagggttgttgtggattaatacatgtaaagctcttagtgcaatacacgacacatagataacatttaattttattatcgttactgttgggtagcactcagttcatgaaattcccacacacagtcaagtggtaaatgctattactttgtaaatatcatcgatgaggaacctgaagctcacagaggttgatgacttgcctaggatcgctcagaaagcaggcagcagagctgattgccatggtaaccatttccaagcttcagtgcccagagatggacccagtctggcatgggcttatcccctggagcactgtgagtgtcttgacagataagtaaaggaagtctttaatttctgaaaaatgcccagctgtgattggcattgttaggggtcagtgaagacacgctcaaagaccttactgtccagcttttttatctttcacctttaatgccgctgttagccccaggagctaaccaaaggggagttttctttatcagttccaagagggatgccatggttgtcccaagattctggagctaaaggtgggaccaggaccagaattcagtttctgtgtttccaaattcagttctattctcctctcagtagaccaggaggcctccagacaagacagatggcagacagctacagtagtttaaaatagcctgagctcacttctgaggtagacatgtgcgtggagtgagctggaagacagggacccctgtgtgggaaagattttggcaaagagaagcccagtggggagttctgatgctaggctgagtgtcatcaggttggggtgagggtgtgagaagagacctgagcaggtgccaacctgaggctgagtggggaggagagaagcgagaggacaggtgccaggcaagatgcggcactgccaatcagtagaagcttcctccctcctttccagctgtgctaccgagacggggaggtcaggtggtcgttctgggagggctggtgccttttacttcccggccttctggcctgctgggtcttggagtccagtgcaaaataatgaagttcctataaagacagtttgtatagatccttttaggatgacttgaaagcctatgcatttccttaacaatgatcaattcttggctaatcctctttcatccatatccgcacccaatgcttttcactccatttccatactggatgttttgaaataaatcccagacaccatataatttcagtaattatcaatctcaatatcacagaaagtcaaatagacattatatatcttctaatatgatgcaaatagaagtggccaatgctatctatgcaatattattactaaagatctaaccaaatttacaggaaatacagagaatatgtaggaaattctacatagaaataacttgatttcttcacgaaaccaatggcatggaagtgtgaaaaaaatagaattaaaagatatagcaatctaagatagtgtgtggacctcatttggaaataaattcaaacaaatcatccataaagaaaacattgtgagataatcaaggagaaggaaacattaactgaaatataaaatgataataaagaattgttattgcttttactgggtgggataatggaattgtggttgcttttttgttgttcttatctgtggagatatgctgaagaatttatgggtaaaataaaactaagcgatgctaggtggggaggaacctatgcatttcctattttttggcaaaaaggccccaaggtgtagtccctagcacctatgttcgaacaatgtgacccagcattcctgctgatccctgactgaaccaggtatggctccacttgatcctctctctggggactgggagttagcattcagaaatgccagctagcctccatcaacagcagactggaaggatcaggcatctcaggaatcatgcaatgtgcatcaaaaaatagagaaagcttatcttcagagagacagacaagtgaagctggctcagaggtcatgtggaccagagggatgggggaagcagttgccttggttcctgacaatcctgcattgaagtcaaactgctgttcctttccctggtttctgtttccttgtaacagacttattcctttgcttgaactgggggcttttagtggggttctgttgcttgcaaatcttaagtactctgagaaacagctaaggagatgaagatggaaaactttgtcatgaagggaatgggttactggaatctttctggagggagaatttcagaattacgaggatgcagttctgattgaagggggtcttgtgggtatctgggatttggaagtgagaatgaatgctgtagcagatgctattagctacccatccaatggcgattccttctttgtttctagttttgttcggtggcaatgtgcccaggggacagtgcatgcatgacccatgattatttccctttcagtgattggtctggaagtgggcactggacccagtttgggtcatgtaggaaagactctttcttttcatcctttcttcctgctctggaggctgttaggtgaggacataattgttggagctatggcagccacattatgactatgaacaggtgcctagatttgtagcaacactgactgagagcactgtcattcttgagacactcatacctccttctttcagactttattattttggggatgatatttattgatgagccccttttggttaagttgcatatggttggctcttctgttaattcaagccagaagattcttaattgatacagttaggcttcataatttggaggtttgggaggaaaatgaggtgaaagagcatgcattgttggggaagataatattttaaatcagaaaattaacattttctaccagaagaccttcaattattatattatagactggtttgcagagccttttgagagtggtgtgaactgatatccatccatccatccatccatccatccatccatccatccatccatcatcttctgtttgttgattttctatccatccatccattcatccatccatctatccatccatccattcgtccatccatctatccatctatccactccatccatccatccatccatccatccatccatccatccacccatccatccatcttctgtttgtcgattttctattcatccatccatccatccatccatccatccatccatcatcttgtttgtcaattttctacccatccatccatccatccttccattcatccatccatccatccatccatccacctacctcatccatccatccatccatccatccatccatcatcttctgtttgttgattttctacccactcatccatccatccatccatccatccatccatccacccatttgactttctttttacgaaactttccctttgatcaatggaggatttccttcctggacttgcttggttctgtctattatcagctgggtataaaatgcttttccttcttcagttaggtcacgtgtagagaattgatattagatagctatggtgaggagtgaatgggattctgcctggcctctctctagggacactttgccttctgcagtgtctggcatttctaagaaacgttgatttttaggcattgaggaaaaaagctgttttttttttttttttttgacattaaaagctctagttttcccttattttattccctggagcttctttcaacatattcaagcactgttggcttcaggcgtggctttgtgggctggaaagggccagggtatgttttcagaggaatcctgtgggattgaattaggaatgctgccttcaggggataagtattattttaataggaagatattctttattttttgattcttaggaattgctgtttctcatgtagatgtacttacctttgttacattaataagttccataaaatattttcagcgtatagaatttttatatatctagaccattgtctgtttcaggttaggaattgtcagtgtttatacgtgcgcctaatcccttgtagtctgttcgttactgggatggtggtgatgggggcactagagggtggaatttgcgcacatggagagaggagatggtgcatgtcagtgtgttttccagttgaggcccttggggttgtgggtggggaggaaagaggaggaggaggaagccagtgtggtaggagtgtgatccacattctcaggaagaaccatatttgatttcatttagaaaacggaattcttacttcttgaacaaagttggcttttcttctctgaacgtggcctttgcaaatgcttgagtctttgagtatggtgatgactgagtgagaggagggatttgcttggggcagcaggcacatctggaaccattgaccacaaacctggctgagcacagagccacccggatgatgggcttaataggtacaaactgggaacttcccctcaggcatgccaactcaggaggttgtcaccagtggctgcagcttggagtgatctggggatcttttaaatgccccaatgccctgcctctacctctgtcagtgaaagcaggctgtctgggagtagaatcagagcagcagtattcattaaaggctctccaggtgactgtcatcagcatccaggtttgagagccactgtggggaaataatctgtactttctataaagccagaagcagtcagttttctgaacatcactgattagaccgtagccattttccagtatggacaaagtaggttctctcctgccatcccccagctgcagcaaacttctcactaatgggcatgctttgagaaacaccaaactgcagggacccaaaggagcatacaattaacgttaaatcacaccagctttgggcatatatatccctcctccaccccaaaatctcttttaaaatagtgttttaaatgtattttttgtagtatgttcacaggactcaaaaaaaaatacaaaatgctgcactattcacaataacaaagatatggaatcaacccaggtgcccatcagtggcagaatactatgcagtcataaaagagaatgaaatcatatcctttgcagcaacatggatggagctggaggccattattttaagcaaattagagcaagaacagaaaatcaaatactgcatattctcactgataagggagagctaagcattgagcacacatagacataaatatgaaactagacactggactactggaagttagagggaggggtgggtttaaaaactacctgtcgagcactgtgctcactgccagggtgacgggatctgtacaccaaacctcagcatcttgcattattcccgtgtaacaaatctgcacatgtacctactgtatctaaaatgaaagttgaaatttaaaaaatgtttaaaatccacacagttttaaagtctcttattctcttctgttctccatccacccatttcccacccccttctctggatatcttttcagaaatcttttccttcaccccctttgttgtcacacaaaagatgacatactgcaacccctattctccaccttgttttttttttttcctgctaatatttggctagtaagcaccagcatggtgtaatgactggcatttgttctgatttgttgagcatcctcagtgactggcagaagctcacatggtgctgccagtctttagatatttgaattacttcccctgtccaccccacgtctagaagatctctctaagcaatgcaaagacagcttccttatactactttttaaaatagatgtagagtatatatatatttgagacagggtctcgctctcacccaggttgcagtacattggtgcgatcttggcttactacaacctctgcctcccaggcttgagtgatcctcccacctcagcttcctgcgtaggtgaggtcacaggtgtgcaccaccacacccaactaatttttttttttttttttttttttttgcatttttggtagagacagagtttcaccatgttgctcaggctggtctcgaactcaagcgatccacctgccttggcctcccaaaatgctgggattacagatgtgagcctggcccaagtattcattttttaatagatgtaaagtatggataattcataatttattaaacaagtcctgtagggatggactttaggtgatttccaatttggggccattacaaacaatgccattaagaatagtgtggccaatgcatcacttcagatgtgtagaaatccatctgtagagttcccataagtgctatttcttggtcaaggggcatgtgtagagtatctttagcgacgggaaatttcacgaaggcatcacattttccagtttgctgtagcaggcagctctgcttctgaaattgtagtaggtacagggttttcttttctttttttccattggtggctttgaggaactttcagatgggatagttgaaaaatgtacatctaatggttttagaggagatgcttctggagctgcagttctcctagggcctttcttgaatgacctgcaggcaccatctggtgtttgttaaaaatgtggaccctgagccctattagactctttgaggcaaggcccaataaatttttaacacaagcttcccaagcgatgcttctgtgcactgaagtttcagaaccactgttctaagggatttgttgtagaacaatgccgtgagaggacatcttttcatatgattagcacagtggaaccacactggtttactcgggacaaagtctgcgactgccatgaacattgcaagctcaataatgccaagcaaagactgagtcttggcatcgggttgaaaataacatttggctatcaacctctgatgcagcatttacaagtttgccctcaaatgcccatagaataggaggaacagggtcaacaacactgaaaatagtcagataaccagttgctggaatctcagtgaaatatccattaactcaaaggcagatggcactggattggatctacccttcacagtcaacacctccaacaagatggaacaagaccaactggaaacagctttgtctatcttccactgtcctattcctagactaagagactcagcttcgtaccaagtgggaagtcactctcttctgctcaaaattaagtttttgaaatgaccacaggcctcttacgatggctaattttcctacattcattcagagaagccagcaagggaaggggaggcagttaacttgtgcagtggtttgtgtagggaactgctggtggtgaattgaacgttcagttgtgtggctgccatacgttaggtgcatagaagagaccgaaggaactagggtgtgagtgcattgtggaatcagagaatcagattgtggaggtgggagaagagtctgaggcagttcaagagagctgcagtggatgagtgcttgctaaaatcccagtgctatatgtgtagttctgccctccaaccatggcttgagaagaggactggaccattactagcgaaaacatcactaggaagggcagcctatacaaccaatcttctggcagacacagggcctggatatatctttccaaagaataacccagtacttaagacaatgcagctgcgtttacagagttttgaagggaaatgttatcatctacatatttgattctcagtcaaactgtcacttatgtgtgaaggcaacagaaagacagttttcagatataaaaaggcactgcaaatctaccaccactgaaaaagttaattgaagatgtactctgattgagagcagatccaaaattaggaacttaagaatgaagaagtcatggtatggaggaactgggatgagcacttccagtaattaaacataatattgagtccaaataattgttataagtctccaattaagtgtcagacaacaataattatttgtgaatgagtagctatatggtgtaaaattagcttcatgatctatttgagtgcaaaatcctagcatataaatgaagactgggaagtagataacataggagcaaggatatgaaaactttacttaatctatcatcttttattggttttacttaatttttcatctttcattgtggaagacagtcagaaaacatgctgttaactttctttaatcacaatgaagtaaaactagaagttaataacaaaggttataaaaaatcaatgacttaaatataaaatactttccttaatgaccctgggacgtgttcaacatagtgctgtatgttcctgttggtccttaccattgcaatacggcaaaaaagaaagaaagaaagaaagcatacaaagaaagaaataaaactgtatttatttgcaaacgacatgcgtatctgtgcagaaaataccaaggaatctataaaacaaaccaatcaaccataaacaagccatcctacaacacataagtgaattcagcaaggttgccagatacaggggaaacatacaaaaaacaattgtatttctataaactagcaatgaatacgggaagactgaaattgaaaatataatactattgacaattgattgctcaaaggaaaaaaataattagctgtaaatccaacaaaacatttgcaggacttatgtactgaaaactgtaaaatgttgatgaaagaaataaagaatatctacataaatgaagacatactgtgttcatgaattgaaagactcaatatagtaaaggtagcagctatccccaaattgatatacaggtttaatgtgattcttataaaaatcccaacaaaattactttgtagatataaataagattattctataatttatatgagaaggcaaaggaactagcatagctaaaacagttttgaagaagtagaataaaatgggaggaatcagtctaccgtagtcaagactatgtgatattggtggagggacagacacataaatcaatagaacagaatagataacccagaaatacacccacacaagtatgctcaattgatttttgacaaaggcacaaaaggagttcaatggagaaatgaattttcaacacatagtgctagaacaattggatatttattggccaaaaaatgaacctcagcccaagtcttgcactttatacaaaaattaactcaaaattgatcatgctattaaatgtaaaatataaaactatacaacttttagaagaaaacataggagaaaatttttggaatctagggtcagggaaaatttcttagactttacaccaaaatcatgatccataaaaggaaaaattgaatagtcggacttcatcgaaactaaacgctattgttctgcaaaacgctgttgagagaatgaaaaggcaaactacaatctggaccaaatatttgcaaatcacttatctgacaaaggactattatctaggatacataaagagccctcaagtttcagctgtaagaaacaaacaatccaattaaaaaagggcaaaagctatcaacagacatttcaccaaagagggaacacagatgacaaataaacacatgaaaagatgttctacatcattggcttttaggaaaatgcaaattaaaagcacaatgagatatcactacagatcaaaatgtcaaaaatgaaaaataatggtaatgccaaattctagcaagggaggctgaggaacaactagatcacccacacatggttgctgagaatgggaactgcagtagccactctggaaaactggcagttttttaaaacatgccaactgccctatgacccagcagttgcactcttgggcatctatcctagataaatcaaagcttaaaggctcatacaaaaacctctgtgtgaatatttatagcaagcaaggaaaaaaaaacccacaagagaaacctaaggtgaactggagtaagaatatagatgagaatatataatattttatattctgatgaaatatagtgttaggatatataaaaaggattgtgttgatacctctaagagttagtcctggaaaacagaacaaagcaaagcaaacaaaagagccaataaaacatctacttctaattatatatttaatcatatatatagatcatatatatatcacgcatatatttatgtaacatatacaatgaatatatatagcaaatatatatatgaacaacatgcaagttagaagtgagaaaggacttataaatccagagatagaaaaattataagacgagatgtgctattacaatggtgttcagactggtactctcggatttatgtcgtagcttttccactactgttttctgaccttgggtgattatttactctctcagtctcaatctcctccactataaaacagggataataacgcagtagttgtatggatttggttaaataatgcatgcaaatagctcaacccagtgttggatgcctcatagaactaggatgatagctgtttttcaatttttggtattaagtttgaaagtccaagaagacagaaatgctcaaattgtctaccataaaagatagactgcctagattaggggttggcaaatgttttcttacaggactagatagtaaatattttaggtttatggggcatctgagcaactactcaatgctactattgtagcatgaaggcagccgtggacaatttataaagaagtgagcatggctgtgttccaataaatctttatcaaaacaggtggcaggcctgcaggctgtagtttactggcctctagtctaaaccaataacaagaaggaagtaatgaaagttttcaaaatcctcaccaaaacctatataacaaatgatccttttggtttttaaaacatttctctagaccatagggaaaaaggacactgtctcacttctctcctcttaccctagcatcatacatacacaaaaatctaacaaagataaggcaaaaaataaagccatggtctaatttcacttataaacacagagaaaacagtcctaaataaaatcttggcaagttgaatcctctaggatattaaaagaacaatgcatcatgatcaaggaagcttcattctagaaatacattatgatttattattaggaagtctattaatacgtcccatcaatatgtcaaaggaaaaatatgatcatagatgcaaaaaaaagcatttgttaaaatttcaatatttgttcttggtgaaaattcttggagaaaggactaagaacaaaaagatactttttcagcatgatgaagactatatgtggccaaccagtagccaaaaatatacttaattttgagatacttaaggaattcccattaaagttaagaataaatgaaagatggttgatagcaacactgttatttgtcattgttttggatgttctagtcaatgaaacaagaaaagaaacatataaatactaattacatattggaaaaatgaataccaaattaacactattcacaggttatattatttattttagcaactctaaaggaatccattgaaaaactattagtacaaataacagaattagttaagagggctgattacaaaacatgtcaaccaaaatcaataactttcttagagagcatctctaacttggtggatgacataatggaaaaataatcccttttggtctccagatgccaccagctcccttttcctcctccgcatgcttggcagaaggccagaggaagtactgtagtcctctactacagagggaagtgtaggaaactggaatattaaccatggattggcaatctgtgtgtctaaaggaaagtggtttacattttcttttaaacgtcacacttggcatgccagatccccatggcgttggagcataccaaagtgatagagcgtgggcataatatgtttcaggcaaaatgtttagcatttgcacagttaggttctcaccaatggtgtgttccttccatagacatgtgagcctggagcttggagcattggagtttgagaaatggcttgatgagggcattgagaagcactagaaaggatatggatagcaactcgattcaaattttatttttgtctacttttctaagtttgtttacttcaagcacttaaactccacttctttgagcctttgttgccttgcctacatactgaggataattaaacctttctcctagggtcttgtagcagtaaatatgattggatgaaaaatacgaaagcatgtcaacaactgcttgttaaaagttagttacctttctgcttccttcttatgcttgactagctcccttgactctttgaaaacatcagaaagcctagccttaaactcctttttggaaactaagcattgggtcccagagcctgaggtttcttaacgtctgcccctagtctggttcagcttctgcctgtttctcaactttgctctcatttcaggaaaggagacaaatgaattattcacgattattgtctcttgaggggcagtgactgtctcttctatcttgttcttccactcccctccggagcatccagagcaactctagaaataggagtgtagaaataaaacccaggaaagagggactttagaaacaagaggcaatgccatggacaggggtggcagaactgttgcccttccagtctttgctctgccatccaccagacttgttgcatgggaaactcagtcaaactctgaagcttcggagtgttctccactataaaaggagaaaaatgatcatctaccttagggtggtgttgtaaaggtcacatatgtgtggccaggcacagtggcttatgcctgtaatcctagtgctttgggaggctgagatgggaagatcacttgaggtcaggagttcaagaccaacgtggacaacatagcaagaccccatctctacaaaaaaagttaaacaatactaaccaggctagttgacatacacctgcagtcccagctacttgggaggctgaggcgggaggatcactggagcccaggaggtggaggttgcagtgagccatgattgtgccactgcatttcagcctgggtgatagagtgagactctctctctctctctttttaaagatacatgtgtgaatgtgtcttatttaactatgttacacatacatataaatataaattctgtttattaatagctcatataatatacagactctgcgcctgtacaaatgtaaaggcaatgcattttacgtaggaaaaatggttgagtcgaatgatttaatttttttacaaatcacacaatacttgcatgaaatagcaacaggtgcgaacctcctaggcagataggagtgcagtgctttgtttcacagataccatcaagcctaacctttattgtgggcttactatgtgtcaggcctgttctaggatcttgttaatgaactgattcatttttttctcataacaacatagaggggaaaagatcacatggggaaggcaccaggtccctggactttgcctcgcgtgctcctggcattttgtagagaggtaaggacttggttccttatggacttttaagctcatgattggtttggtctggtttcaattctcatcttcatgtatgctcttagaaataatctcattttaggagagaaattcagagtcaacacggaaactgaaaagctctagtactgcctgaagtctcagaataaagggtgccttcattttcacttttccaaataatctatgagagggacttttagtagatccgtaagatgtgatactaacatagtatctgcatattgtgaaaaatttataactgtatccataaaggttatttgactccattgcctcaaagtctatataattagaattccatgatgtcatctttgagctttaatatagcttaaaattatccttctgtaggttgtgtttctttctgaaacattttaaatttagaaaattaacttgttaaacttttttaagttaaatctttagatttttttttattcaccctgctgtgggggagtcagaatgacaaatgcttgaatcatcaaagtcaaatgttagggcattttagcccctctgggaaagctaaggtctccatggcccaagaatctaactctacttatggggatgatgatctcacatgatctcatgatctctgtgttttgccaacattccttcttggcaggacttaggagtgcagatgggccccagagagcatgccttgctcaagccaggtccccctcctgctgccactttgggtggctggaaaaacctcacaaagggtgcagtgtctgcggttgggagactggtctcaattttcctccatcacctgctcataaactctcatgggtttctgggtcacagtgcagccctaggtcaatcttccaaaagctgatttgctgaatttcatgtgaattgactagcttcatgtcagcattttagggaacatttgattggtcttcatgcctgctttctgcctttgcaggctgagaaacaatgaggggagagaatgagggacagagagaggaggggactgaggggccaaggaggttccgatgagcaaaaatggaagagaaagaacgtcagagaggaggctattgggggatgaggagagagaccagagatcaagaagcatgaaggtattgagggccagagaggggacttctagggacatggagaggctgcaggacagagaaagggctaggggaacgggacagtggttctttcatttcaatgatcaaagttcccagctttttgacaccacaggggcaccctgacaattctggcaataagaacatgaaaggcctggtctttatttcactcaattcctgctatgtgtggtgagtgtgggtgagccaaggggaaggtgatcctattgtcaggaggtaatttaccatgaataggggatgatatggaaataatgtgtgtgatccttcccctgccactgttgggatgtctttttaatttccttccctcatttgtcacagccgtgaaaatactttttctgatatgatgaatgacagatggcagggtgccggcagcccttctggagggatgggaggttgtgtgtgtccacgataggggcccaataagtactggctgaatgagaaaatgaggagcctcactgtgggctttctttggggtgaatggaggtgctgagtgacctctcagcttcctagaagtcacaggccagaagccgtggaatctcagtggtggaaagtcctactgatttgaggatcagggagggagagaatcagcaatggtgtgctgataaatgtttagtagttggctctctggtaaaaaagaaaaagaaaaagaaaaagaaaacaaaaacaaaacaaaacaaaaaaaacaaacaatgaacaaccctggtatgcagtgcttgccactggtcagtttccatggtcagtttctcaccatgggcaatttcatgtgccatcactgaacacagagtagggaagagatccacgccattggctcacaagctggccctaccacaccaccaggaggaatatatattgggcaacgactaatagcaatagaaaaactcatgcttctttctcctggcatgacttcatgtatatgacatacatcctctcattttatgcttgtagcaactctgaaacctaagatttatttcctcattgcaggtggggaagccaaagctcagaggggttaaataatgtttctgttattgtacagcaaatcagtggcagagtggattctaagattcgtgccttctctactcacttcactgggctgtcagaggttaagggaagagttacataagccacctctgattattagagaatgacagggctggctaattctgcctggatagtattgaagaggagcttcattcaggggcaccgctttgctaaagagaccacccaaagaatgagtagttttgagtcaccaggtaccctgaagtggtacctgaaggtacagctggtatgatggatgacagatgccggtaccttgctgtcatccatcatatcagttgtcagttaccaggtagacctagcggtaaagggtaagttatatctcttgcctaaatgtcagtttcctcatctgtaaaatgggaccctgaaagtctactttagagggctatagggttgttaagatttaatgagttaagtccataaagaacctaacgtagtgtcagacacataatagatccagagaaatgctgattcttagcaggctaactttttctttttgaattcctctttaggccagaactgactagtataggcttttcaaactttagcgtgcagaagaatcacctgtggatctaattaagatgcaggttgtgatccagtaggtctggggaggggccgggcctggaatcctacatttctaacaagctgccagatggtgctgattctgctagtccatagatcacacgttttctttcattctttctttgtctttgtcttttttttttttgagacagggtcttgtgccgtcatccaggctgaagtgcagtggtgtgatctcagctcactgcaacctccaccttctaggcttaagcgattctcttgccttagcctcccaagtagctgggattacaggcatatgcaaccactgctggctaatttttgtatttttagtagagacggggttttaccatgttggccaggctggtctcgaacttctgatctcaaacgatccacctgccttggcctcccaaagcgctggcattacaggcgtgagccaccatgcccagcccatggatcacactttgagtagcaaggggctaagggatcctgacatagcattttggggtcctgcagcttcaacttactctgctgcctgttcccatgacctctaagactgctcttctcgagacagcatccttgttctgcactggttcctttggagcagctgctcagccctgctaaaggcatcttgctcagtgcaatattagtttgctgcggaagatctgggacctgggctcctctcctcattctccttgatcttagttttggttctgccaggactttgctgggcaatctttgtcatgtcctttcccctttttagattcaatttcttgatttgcaaaacaagacagtaggagagagtcactttctagtttaggcattctgaagttctgtgaatctgtgataccagctggttggtgcattttcctgccaggccataagcagtacttgcctttatttctgggctccagtgggggtcttcagagatacatagatgcatatagtcaggacaagagttaggaggagtaaaggtaagggttcaatccaaaccttttggaatagtaacagggtggcccagagagatgaagaatgattggggcacaggaatcttcttgctttggggcctaaacgacatctccagggaatggctactcattgggcacatatgagccaggcactgtgccaagagctaatgggagacacttgtcattctttctggccacacactctggagccgctttttttttttttttttttaatatttgtgaattcgccacctcataaacccatgtctctttaatgcacaactcagaaacccactcgcccaacctcccttgcagctagagcacagacatgtgacctaggatctgtcaatcaggtgagtccttgctggactctgaattggtggctagaagcagcagacactgtgtttgatctgttctggagggggaggtgttaagtatgtccagactgcagagtcagctatggtggggcttctagcaagatctgtcccttgtgaatgttgaatattcacagcatctgtagtgcagattgcctggtctggactctggagtggtggcagcgggttctgtactgtggtcaagatgtttcttctggctttctaaatgtgtcctaattggattctcagggcctcccaaagcttgtctttcctggttaaactggttagagtgggcttccatgtttataaataagaatcttgactgcttacaacactttatgtgtgttatctcattgaattctttttttaatttttgagatggagtcttgctctgttgcccaggctggagtgcagtggtgcgatcttggctcactgcaacctccacctccagggttcaagcgagtctcatgccgcagcctcccaggtagctgggattacaggcacacagcaccatgcctggctaatttttgtatttttagtagagactaataaggttcaccatgttggccaggctggtctcaaactcctgacctcaagtgatccacctgccttggcctcccaaagtgctgggattacaggtgtgagccaccgtgcctggccctccttgaattctcacagtaacctagtgaggtaggtgttattatcctcttcttgtaactgaagaaactgagtcaagaagagatgaactaacttgctcaaggttccactgtcgataagtggaggcccaggatttgagtccagatcctctggttccaaagcacacattcttaaccaccatgcatctcctgtcagagatttgtgggtgtggaaaggtccttgcaaatcacttgtcagtagtacagggtttcatgagatctacacctgggctgggcacgcctgttggttttttactgacaacgcataatttttcgaggagtggtaatcagaggcaaccgttctagtgacagtgattcaggcgtaaacacttggctttggcccagaggttgcactgtgtgagaccacaggtgaacactagaatgtttacactcttccggagtctgtaggtggatgccagggacagagaatgagattgtaacccagagaaagaaagaaaagaaagaacgaacaaacaaaagaaagaaagaacgaacgaatggacaaaagaaagaacgaatgaaagaaagggccagcccctggggcctccttagataaggaagagaaaggagaccttgcctcaagctcagaaactggttaaaacacgagcccagtcacctagtgataagcagtgcttggttctattaactctgacaacatagtactatcttgggcagagctctttggagaagcaggttggctaactggccaacctcagttgattctcatggtcttggaactttcctgggggtccaacttcctccgttctgcccctcttttttctctaccttctatcgttttattctttgtctcctttatttttcttcaacaaatatttttgagcacctattgttaacaattcaaccaatatttattgggtgtttgctcggtgccacttacagttctaagtgctggagatacagcagtgaactagccagacaagctgtcatagagtttccaatttagtggcagtggggtagtccagtaggcatgaagccaggcaggtaccagttgttgaggtggtggtagttccacccagtactaggaagataacattcttatccccattttacagatgaagacactgaggcaagagagcttaaattaattgcctgaggtctcacaggtaggctgggatctctgtgagatctaggagtgccagagccacttgggtccagccacccacacctcttccctgtgcctcaggctgggatgacacccagagcctctcctttctccctcacctgggcccagagaccacctccttccctctccttgcattgctgctgcccatgctaaccgaaggagcctcgccgtggggcggatgtggcctccccagtggcccacttcctcctgcttctgccaacagcagcattggcccctatgatttgaattttttttttttttttttttttttttctgttgatccctctagcggcaccagatgtgggtggggtggagggtgggtacacccacactcccttaagcctggaagtaacctaggttccagactctgtgtgtccctgaatggtaatagtgactctcttcttagctgtctgtcccactgggtcctcccactccccaactggtgctcctgcttttcctcagaatgggggacataaatctccttctagtcccaacccattgtcaggcagggcttcctcctggagggctgacttcccaggactgggccagctaaaagctaagcagtatgggtaagagcacggggttctggagtcagacagacctaagttcaaaccccagtactgccgtggacaagctgtgtggcctcagacaagttgattaacctctctgagttccttttaaaataggctgaggtctgtagggataaggtacctgaggtcttagtgcctggcacagagtaaacccacgtgttggctgtttccattattgggtagaacagaggggcctcctggcatcagtgggcattttgggcctgctgctgtcttgtctatctaggccttggttttgcctttcaggctggtgcctctttgcagtttcactttagcaagtgaaactttatttttcctgtttctcctgatctgtttcctccttattttccatagtgaataatcacacataagcctttcttttctcagggcaaggttgctgtctgtgaaggagtggaatgcctgagcatccctggtaggaaaggaagagtgaccagcatcaatggggtactctattccctgagtagcaagccctcttcccgccttgtccctggctcccacacctgttatcctgccggcagtcatctccagtatcccagaggagccatagggatgggtgtttgaatataagaacactctgcagctcagatatgcggcattacttttcctgtttgactcagttctgcagagggttgctgagtgactgtcatgtgcaaagcacgtgggaggaaagatgaataatgagagcaatcgaatgcccattcccttgcatccagggtgctctactagacctgcgttcttccatcattctttcagcccacgtggttgccaatactgggagttatcagtcttttccatttttgccaatctaatggataaaatatcttgtattaatttgcatttcccagatattcatgagattaggcatacgctttttgggcacttgtatttttttctctgggaattccctcttcgtattactttgtcaatttttctagtggcttttttatttgagacagggtcttcctctgtcacccaggctggggtacagtgtccagatcacagctcactgtaacctcaactccagtgatcttcccaccttagcctccctagtaaatgggactacaggcacacaccactatgccaggctttttttttttttttttttgtagagacagggttttgccatgttgcccaggctggtcttaaactcctgggatcaactcatcctcccaacttagcctcccaaggtgctgagattacaggcatgagccactgcacctggtcccctgtctttttttttttaattaattgatagtaactctttatatattctagatgccaatccgtgatttagtctaaaaataaatccccttggtctgtcctatgtcttttcttttggtttatgaaatcttttgtaatacaggaacgtcacacttccacagtcaaatgtgtcagtcttctaaatagatataggtaccttgtatatactccttgatatatcacattgattggtggtgacctgtttgtctccctggctgtcagactgtgagaaacttgagggcaggggctgtactttattcttctctgtctctctagggactagtgcaaagctgggcacagagttttgtgcctgaatgagttttttttgtgtgtaaacgtggtataaaacaggtcttgtgactgaatgagggaatgaatgaaaaagccctgtcctgccctccctgcagagatggggtctgctgcagagatgggagtgagtcagggagtgaatcacaagctcttccgtggctcagctgacatttcaaaagccctgagcagagaagcccccctcattccaagagagcctccgcctctttgagcaggcacagtgaagctctgctgattatcaaactctgtgtgtgtatgtgcacgcacgtcaggggtttagcagttaaaactcttagtgctgcatattctgcgtatgtgtgaacaaggctttaaaaaatctctcagaggacctgtgtatgtgtgtgggtgctgggggctgcatagagagagagttaaaagagatgagggggtgtttagaatcgttgcaatgtattgcatttgtttctgggagggtggggcgactggagggggttaaatagctcccagaggcgctcttgtgagcggagcttcctgaaatctctttatctgtggccacatgctgttcttggttgtccacgtggttccctggtgtccctgttgctgaaggcacttctgttttgttcttggaggcttggcttctcattgccattttctaaagcagtagagagtgccagttagattgttagacccaaataatctgaaatgtgtgaaaaaatagtaaatatttactgtaccttttgtggaacaggttattgccatggaaatgcactgtacacgaatctggatgatggagggaagctggctcaggagctatgggagtgtttggataccatgccgcctgaattggcaggtttaggagtgagtgccgtgggtttagaatcacagtgtggttgggtgaggctgaaacacttggtccccagtcaacctgtactgagaggggcatttattcattgcttcccacatgcagggtgcttcctagagcattctccatgcattattgcgtttaatcatcatgccaccccaatgaggtgccattatcctccctgttttacggagacacagagtgtttgatctacttgcttgaaggtacgcagtcaatgaatggcagagccccctgactctgttctctggagcttgatccttccctgctcagctgtttctctcactgtgatttaccctagagaaagctaaccagctgtctaccggggttttattttccaatattgacttcggggctgacatttagaaaccatcaacaatttccagcttctcttgaaaatgtgcacaatctggctactgtgtggggcttccctagtggctgctcccgagcagccatccaggttagccgggcatcagctctgcagttggcgctgggcatcctcctgttgcagctggggagaaagcatggggtatcacacccaggggctccttgaattaattgagaactgtctgttgagagctcctcatcctgttagacttgacatttaatttagctgttgttttcatttgccaattagagcttttgagattcttttgattttcttcctgtggtctcaaggaatttgtgggtggttgagtgaagatcttcatggcaggaaaggaaggctgcaacaggagatgtaatgcgtgagcacattcattcattcattcattcatttacttgtttattcatttgttcaacatattcattgagtattggatgttgaagttacaacagtggaagtatggcaataaataagacagacccagtcactgctctcaaggagcatatagtcaaagagggcagtcagacatcaactatgatgcacgttacagggaaggcatccatcttttttttttttctgtgtcacccaggctggaatgcagtgatgtgatctcagctcactgcaacctctgcctcccgggttcaagcgattctcctgcctcagccttccaagtagctgagattacaggcacccaccaccatgcccggctaatttttttttaaattttattattattatattttaagttttagggtacatgtgcacaatgtgcaggtttgttacatatgtatacatgtgccatgtagtagagacggggtttcatcatgttgaccaggctggtcttgaactcctgacctcaggtgatctgcccaccttggcctctcaaagtgctgggattacaggcatgagacaccacgcctgaccagggaaggcatcgatcttagactgacttagtggtgtctaggtctctgaaggaggtgtcagagaaggtctccttggctaatctttgtgaccaccggagctctgttagtttcataagacataagtctcagcaactgttgcagaaagacccttcctcagtaaggatgatgggctcctcgggctcttgcccttcccgtcctgggaggaaccttctatcaagagccatggctagtcatttcatccattgggaatgagcttactggctccatttatgagagttagtttagactgaggagtaaaggaggagtgaaggagtttgggagttgtcagtgataagcatgcacatttggagttgacaggacagcatggacactagagcctgaacaccttagttcagcttagctgcactgcctattatgtgatactgggctggtttcttaactgttctatgcctcagtttccccatctgaagttgggaataaaatactcatctcatagggttattgtgaagagtaaatgagtcaagctgggtgtagcggctcatgcctgtaatcccagcactttggaaggccgaagtgggtggatggcttgaggtcaggagtttgagaacagtctggacaacacgatgaaaccctgtctctactaaaactacagaacattagctgggattacacatatgcaggtgtgtaatcccatgaaacacatttcaaataattgctaaaatttttcaagctgtggcataagagacaacagtcctgaagaggactgaaaggtcttgggatgcaggggagcttaatgtattaaaaggtgacattttggatcagtagggaaaaaattacacacaggtgtgtgtgtaatcccagctacttgggaggttgaggcacgacaatcacttgaatctgggaggtggaggttgtagtgagccaagatggcaccactgcactccagcctgggcgagcgagactgtctcaaacacacacacatgcacacacacacacacacacacagccaggcaaaggatgaagagaagcagttaataaatgtgagccattcacgtgtgtattatgattatcacgtgatatcagccagtcctgcttgagactcacttttccgacagttctttcttcggtggactgtacccatgcccctgtgtgccatatatttgtgatttccagccttcctttctgataacttcaattcattgctcttcccaggcaagtccttcaatggttatggggtgccgcgcttgccctcatccccagctgagtgttctgcgtttggggacttgtgtttataagtgtgggaggctgtcccctgggggttactgcccagacagttagggttgtccataataacagaaaagtgcatggagagagaaggtgcaggtccgcctatttgatgttgggtaggatgtgctgcttgatgaccggtgaaacatttacttctcccaccatgggcgagaccttggatgtgtcctttacctctctctttgtcacttctgtcctgaactgcccatgagtgaccaggggcttccgacagaagtgtctcacaatccaaccacacagcagaaaggcattttcctttggatttgagctttgtccctgcactgactttttgtgtcatctcctcttcattcaatgtgagatactcaccttgattcatagaatgttttctcattccaggtttgtatttttttaatcaccaaaagaagcacttatcataaaagactgtgatgatgtataactgtgtatttagtttgaaaatcttcaccttatagaagcaataaacaatatttaggtgtattatcctgtgaaatttttataaatataagactttattacgaataaacaaaaaaagagatcatatcctatatactttttttataattttttttgagagagggccttgctgtgtcatctaggctgaagtgcagtggtgtgatctcagctcactgcaacctccacctccagggctcaatcctcccacctcagactctcaagtagctgggactacaggcacgcgccaccacgtccagctaatttttgtaatattttttttttgtagagatggggttttgccctgttgcccaggctagtaactttttcccttattaataccttatttagatccaccttatgttttaaatggctgcagagtgtttcataatatggccaccatattatttacattcatatttataatttgtctaaaacattagcaataggcatttggattatttccaagttttctctataatgaacagtgcaacagtgaacactcttgggcactgtagtggggatttccatagaacaattcttagaaatggggtgtttagggcaaaggatattaacatttttagttgtaatagatattgctaaattgctctcaaatgttgtgccaatttatgcacccaccaacagcgcacgaaagtgcctcttagaaaatgtcttttagaagataaaatacctattgttaagccatgaaacacatttcaaataattgctaaaatttttctagctgtggcataagagacaagagtcctgaggaggactgaaaggtcttgggatgcaggggagcttaatgtattaaaaggtgacattttggatcagtaggaaaaaaaatggcttatttaatacatggtgctggcataattgggaggccatgtggaaggatgctgagtttgattcctaactcatacaaaaataaattacaggtggagtaagctataggcagtaaaaaaaaaaaaaaaaaaaaaaaaaaagaatattagaggaagttttaggagcatacttctgtaaccttgagtgagggaaatccagaagccataaagaaaaagattagacagtttcaattatgtaaaaataatttaatcttttaaaaggagaatgtattcatgaattgcttatgtaataagaaagactattaaaaataggtccagtagataatgtacaatggtttccaatgtgaataaagttgaagttaataaagaaaagaaagttttaggacatgtcagggagtttttgttcaaggattgagattctgcaatgtttattctaaataaagatgaatgatagactagtgcacatgtagtaaactagtaaatgtgtagcccataaaccttgtaagccctggaagggtaaagaaaaagggaaggaaatgttgttttctgcctctttattttttgttgttttgagaaagttgagtacccacccaaagccccaggtgtcccaggagagagaagattgaaaacatgccatcaaaacaggagcttcagcctcagccacaagctccagtgtttactgggggccagtgcccttattcccacgtgaagcatctgccttttttgcccccttgaagtctgagtctctcgtctgttcctggagatttttagccaagcccctcctccccacccctcaccttagtatttgtaccaccctctgaatcaaccccaaagacacccctttgtactcttcccttcatctggccatcaccagggtactgtggtcattgaagctgagtgtgtgccctcactttccgtaaactcacagttcctttattctgcaccttcagggattgcaaatcgttaagggtatgccttcaaataccagccctctgacttcctagctcaataacctcacacagctctatatctcagtttcctcatctgaaaaacagtcatgaaatggcaccacctcctagcattaatgtgaagattgttattattatgtgttattaattattattatgttatcctattaatatatgagacagaatctcactctgttgcccaggctggagtgcagtggcacaatcttggctcactgcaacctctgcttcccaagttcaagggattctcctgcctcagcctcctgagtagctgggattacaggtgtgtgccaccacgcctggctaatttttgtatttttagtagagacagggtttcgccatgttggccagggtggtcttgaactcctgatctcaggtgatctgcccaccttggcctcccaaagtactgggattacaagtgtgagccactgcgcctggcctatcttattattattattattattactttttgagatgggatctcactctgtcacccaggtgggagtgcagcagtgcaatctcagctcactgcaatgtctgcctcctgggttcaagcgattcttctgcctcagcctcctgagtagctgggaccacaggcacccaccaccatgcccggctaatttttgcatttttagtagagatggggtgtcaccatattggccaggctgatctcgaactcctgacctcgtgatccacccacctcggcctcccaatgtgctgggattacaggtgtgagccactgcgcccagcctctttttattattatacttagcacggcacttggcacttaggaaatgttcagtatatgttagctattattggctactgttatttcttcttcttctcctcctcctcttcttctttctcctcttattcctcctcctcccccactcccttccaccccctcttcttattcctcctccttctcctcattattattttaagtacctccttaccaatgcctacagaaatagactgacctagtaccaggatctagaggagttcaatcaagttcgtctgttgccttcaaggtaacagcgtagtggtggttccgagccagatgccagacccagtctgcctttgttcaaatcctggttttacacttaatactgtaggtacctcgggcaagttacctaacatttcttcacctcaatttctccatttgtaaaatgtatataatgatagtacctaccacgcatggttgttaggaagattaaatcaattaatatttgtaaagtagagcagccggctcattgtaagtattgggagtattggttaaaataattacaaaataaacaatctcacttagatacatcccttaccccctgtggattatgtcaagggtgaaagaaacagtgtgcttgaaatcctgctgtgcgccgagctgtatatcagaggtgttatggtgattcgtcatcattctcctgaccactttccatttttcttttagagtcaacactggccaatctttagggaggagctctgatcattgagaaactgacactgtggaagggggcatttctgactctctcttcctagctccatttgatcttcctaaatctttcaataatgtgtcattggggtaggaccaaagaaaaacggggtgaatgtacggttgctgctttgtttcccatagtgggagtgactctgatgtttcacaaaggcaggggtggagaggcagcgcctcgcaggaaagccttcttgctaaatcgaggacttctgcacagaaatagatacaaacttgcttactgtttaaatagaatattagcgattatcttttatccagctggagtctcctcggtttggtactgcctcaaatgagcagcctgcaatcttgggtgtcacttcctcactggttctgctttccataactgtgttgaaatcactcccccagaaggtcaccaaaagggaaaatattagtgtgtgtttattggcacgatcttgcaggtgctgggctaagtgtagacatgatttattttcatttaatcttcaaggtagttctaggcgatgtccccccactttgcagatggggacactgatgtgcaggaaatgaagtgacatgctgtagcactgttggtgctctgctgtgtcccctcacccttccatttcattgcattctggcctggcttccaatgggcagcaactgcagctgttcacctgagggcttgctctgccgtagtccattcggtccataggcatgtcaggctgtggaagcacaggaggagaggtgagggatggtgcaggagagaggagaggatgattaatgtcccccagggcccatcctcaaccaatgacttatgggaaacaacctcctagagttgtattaagctccagtgacccagaatggtaacaagctcacaaacacttccttttttaaaaaatttcacaaaaatactttattatacccatacctccttgttttagcccatcccagtacggtggtatcttcagaacacttccactttcccctctcctcacctcttccctcccacccttgagatgtaatctttggaccacttttacttctttgctttctctcagcaccctttctcccctactctatggtgactttgtgtttttgaattgaagtcgtttcatgtctgtgtcttttttttttcttcaactgttattttaagttctagggtacatgtgcaggatgtgcagatttgttacataggtaaacacgtgccatggtggtttgctgcacagatcgacccatcacctaggtattaagcccagcatccattagctattcttcctgatgctctccctcttccctccccactctgacatggcccagtgtgtgtcattccccaccaccaaatgtccatgtgttctcattattcagcgcccacttataagtgagaacatgcagtaaaacactgcctttataggcttccttcccttcactgtcttacttccccactccctactgctgctctctgggatcacctctcacagaagctgtttgtactttaatcattgtctgagagtctggggtatcccaaactaagataattgcccaaggtcttagctaaattcaacagccctatttgtctttatcctccttgtggcaatgccactactaatggatgtcccttcttaaaattcttccccattttggcttttgtgacacgtaatagaattcttctacttctgattatttctttcctttttcattaattggcagctctttctttttaaaaaaatttgctagatttttgcttatttttttttttaagaaatgaggtctcattatgttgcgcagactggccttggaatcctaggctcaagcgatcctcccatctcgtcctccgaagtgctgggattacaggcgtgagccactgtgcccatctttcttttcctttctttagccacccagttttaggtacctccagtatcccagtattttagttgtaagtgacagaaaatctgactcaaattggtttatgtataacaaaatgtaagttattggatcacatacttgggaatcttaggataggtggcttcagggaagatatgatcaaggtgttcagcaatctgattctctctccatcatgattcagctttcctctgtattgcttgattctcaggcatgtgcttgactaatgaggcaacaacaacttgcaggtccaatcttatcttcatcaatggtatcttaactacatcagtggtataggactgcttctttccttagagtcccactgtaagttttgggtttcattctcattggcctgtgttgagtgatgtatacatttctaaaccaatcacagttgccacggagatgtaatacaggttgagcatctcttatccaaaatgcttgggaccagaagcatttctgagtgtggattttttttttcttcagattttgaactatttgcattttacttgccagttgagcatcccaaatccaaaaagttaaaatccaaaatgctccaatgagcctttccttggagcatcatgtcagtgctcaaaaggttttgggttttggagcatttcacattttgggttcctggatttggggtgccctcatttcccaggctgggtcacataatcacccttggagctaaggttagagttgagccctactccataaggactgagagtggggagaggtgatttcgcaaaggaaagtcaaagtgctgtcacatgaggggatgggtactggagaggcaaaaacaacagatgttcatactccgcatctctgggttcatttatctgctcttctctttctctgtgaatcatctgatgatttccactcctgcctgcctgagtaggactctgaaactcctgcctccagatctgactccacttctgagttgtagcctcctttcccccaccctctagagttaggcatttccatttggtggtgccatgcagacctgaaactcagtgtgccacaaccctcgccacctcccacctggtttcgctccctaacgtccctgtctttgtcagtggtgccagttgggtttccatctctccctcatccgtcccaacccccacctaatttccagccccattgtgctgcttttgattccttgaatgcacctttgcaatgcttttccttggtttgtaaccctctttagcatattcttggtttggtgaacccctggccatatttagatatcagctcagaattcacttatttgggaacctctaacctggtcacccatctctgccaagcctgagttagatgctctttccctgagttctactaggccttcatctcgtctaccacagcacttctcactcagactccaatgactggctccattgcctgccttccccgtaagggcaggggcacatctgtgtaattcaccattgtatcttcagcagtccagcctgacaattgagtctaggctggtgtccaacaaaccagtctttgttttttttttcttttattttaattttgatagttttgggggagcaagtggtttttttggttacatggataagttctttcatggtgatttctgagattttggtgcacccatcactgtaacagtatatgtggtatccaatatgtagtcttttattcttcaccccctcccaccattccccggagtcctcaaagtccattatatcactcttatgcttttgcatcctcatagcttagcttcatttacaagtgagaatatatggtatttggttttccagtcctgagttacttcccttagaacaatggcctccaacttcatccaaggtgctgcaaaggccattatttcgttccgttttatggctgagtagtattccatcatgtatgtgtaccacattttctttatccactagagataaaccaggttttgaattcaggatccacctctcctgagctgtgagcacatgggcaagtttcctcaccagtccaagcctgttttctcatctctaaaatggagacaatgacggttcctccctcactgagcacttgtgagaagtaagtggtgatcacggttacaaagtgttcagcacagtgcctggaacacggtaagcgttcaatcagtgccaatgatcatttattatactcactatgaacattatttttacctcatgcagtgtctagaacataatcaactctcaacaaatgacagctcttattattagccaagaatggaacctgaaacatagtacgctccatggatcattgaagctttgtttttgaaagtttgaaattaacaaaaagagcctttgatgtttcccttgctgcacattcttcccctccaggtggagtgggcagtttccactgggtgctggaaccaaccctcctgtagttggaggtgatcttctctgatgtcactagggtgccgaggtgatgtgtcaccagcacttgtttgcttgtgtgatgtaatgagggtggacttgcttctcctagggaagagcctcattaaggttagcaaggggcttgttcctgggaagttctaaggaccgcctggggctgccacataaggaactccccttttctcattttgtctccggtaagttgttattgatctgtacatgatgtttctctttcttaccagccgtgggaatgggccatcctctggcatcactgttgccttgaacgttaccatcaccaccgttgccatgaagtcatgacagcagcaccattggctctggtttattgggtgtctaccatggacagtagtagggctagacatttagtatactccagggctactgcggggattaaatgaggtatgaagcatctataaccccacggtccaatagggtagccactagccatgtgtgcctactgagatatacattttaattaaagttaaataaagaaaaaattcaatttatcatgcacagtagccacatttcaagtgctcagtatgtgctcatggctgatgtagctggcagtgaagatggggaacattgtcatcatcacagaaaattcttccacagcgctgatctagatagaacaggattcagtccgctgtggcttgtggatccatggactgaattcatacacacagaattttgtgggaacacagctgtgcctgtttgtttatgccttatctatggctgcctttgcgctacaaggatggaattgagtagttgtgacagagaccatgtggcctgcaaaacctaaaatactcagtctcttatccttgaagaaaaagtttgtcagcctctggtctagaacattgcctggctcttggtaaggttaaatacatgtttggaactttttatttattgaaaataatatacattttgttctccacctaaccttttaaggtaagtattgttatccctgtcctagagatgagaaaactgggactggaattctgtactgtcacttccagggggcaaacacctcatgaggttttttttttttttttggcagtcttgctctgtctcccaggctggactgcagtgtcgcgatctcagctcactgcagcctctgcctcctggggttcaagtgattctcctgcttcagcctccccagtagctgggattataggtacctgccccctctccccgctaattcttgtatttttagtagagatagggtttcatcatgttggccaggctggtcttgaattcctgacctcaagtgatccacccgccttggcctcccaaagtgctgggattacaggtgtgagctaccatgcctggtctcatgagtcttgttcatcacttacctccttttgttcttccagcttcagtttcaggttcagggggtacatgtacaggtttgttacatgggtaaattgcatgtccctggagtttggtgtactaatgatttcatcacccaggtagtgagcatagtacctgatagtagtttttgatcctcaccttccaccctcaaggaggtctcagtgtctgttgttcccttctttgtgtcatgagtgcctgatgtttagctcccacttataagtgagaatatgcagcatttggttttctgttcctgtattaactcacttaggatagtggcctccagctgcgtccatgttgcagcaaagagcatggtttcattcttttttatgcctgcatagtattccatggtgtttatataccacattttctttatcccatgcaccgtggatgggcacctccgttgatttcttgtctttgctattgcatcacttactcttgaatctggagcagtgcctagcacataatagacattcaggacatgtttgttgagcaatgaatggatgagttaggaatcaattacatataaatcaataatcaataatcatcaatgatgaatttctatgaacaaatatgaaaattagatcggccgcattgtagagatgaggagacagccctgtagaaggaaagtgcctcatcaaaatgcaacatcgctgtgaaagtgtagacttggagctccagctgaagtcatctgtgtattttctaagctgtcccctctaccatcctgccttctccgggagctgccaaagtgcagcgctgatgcctcctctctctgtcccacagcctgacttttgttcagctcctgcttctcttcttcaccaactgccagcttcagctgctttgtggcaccctggggcttgaagcttcatttctggtgctgtggcaccacaaagctctgccccagtgtcacttgagtccaagtagatcagccaagtttgaatgatctctctcttggccacttcagtctatgaagctggagttgagaccatctgtgattttacacattcgttacagcaaaaccaagagggccatggggtaagagggccattaagctagaggctgagcaaaactctgctcttgaagcaccttctgagatggcttctcatggaacgtctgcgcaaagtggcttcacatccaattaagtcaaagatgcattaaatgaatccagtttgtaactgcttccaaccatgaagtcacagttccatctcttgccctgggaggggcttctttcaggctctgaggactggagccctggagactttattgccttacggtttcctcctctaccatcagatgtttctttttcatgtgttctggcctggatttgaatagactgcctggatttgaatgctgccttcacctctttctggtgtgtaatcttggacaagttaccttctttctcagtgcctcagtttcctcttcagtacaataaggataataataagacctaccacatagctgtagagaggattaaaggagccaatatgtggaaagtatttacaacagtgtactgcatagtagcttttctataagtgattattattattatcccttcgaatctaaaatccctctagtttgtttcagaggagcaaggattgtgtctcgcctgcctttaaatccctttaagttgggtgtctcaagcccaaccatctgcaggagactagaaggggacttacatgagtgaattgaatcaggtgtggatttctgtgaactagagaatgcaaggctgtctgaaaggggaactattccttattcatgcatcacatatacactggtgtgccaagccctgttctgcatctggggacacagcagagaatgaaccgggcaaaattccctgcccccttggagttgatgttgtagtggactaagctctgatgactctgttgctgcatgagaatgtgggcccactgctgacaaaacttctgatttttctgtaagaaaagccggaaacctggatttgtaaaaaccgtgaactctcctagcttaagaattggcagtggtttccatttttttttttttttaaagcacagtacatgctgtgaacccaagagccagtttgcagcccctgccttaagacactcctctaattgctctgggaggaggcctgtctctgccctgcaaatcagcagctggtcggatttcaaggtcgttggtgtggagggcgcctcctccctctcctgcgtggaggttattgtggctttttctgcccacagagcagatgacgctgccaccaggcagtgagttagaatattccttctcttatccttccttttggatggtggccttggctgggttcccagccccctgacagcagaagacaaaaggatggaagcagcttcctcatagtcacccatgggggcgatagggtggtgatggtgatgtggagaaaatgcattgggtcaggacagccacctttgaagccagaaaattaatgatctctgttgcctgaatcttttcaaagtggagaagtaatttaaaagcttgtgtgggaaggattgagaatgggattgagaaaagaagtttaggttgctatcaggaacaattcctaacagcaggaggtttttggagaggcagtggtgaaattccttggaaatttttgtgtggtgtctttttttcttttttctttctttctttcctcttttttgtttttgtttttctttttttgagatagagtctcattctgtcacataggctggagtgcaatggcacaaccccggcccactgcaacctccacctcccaggttcaagagattctcctgcctcagcctcccgagtagctgggactacaggcacccgccaccatgcccagctaatttttgtatgtttagtagagacagggttttgccttgttggccaggttggccttgaactcctgacctcaagtgaggtccacctgccgtggccttccaaagtgtttggattataggcgtgagccactgcgccgggccttttatggtgtctttgaagtgcttgtttaaatttacatgtggttgcctctcagtggggtgcatgctctctggttttccccaagccccaccactccctgttgtgctttacccacttgcctgacttagttatgcttactggcctggcctttgtgggtctttgagtttgtgccttctgctctgaaggaagcatgcttgagatgatggaatctaggttcaaacctacctgccctatctgccctttactgacttgtgtgactgtggacaagttcctccacccctgaggttgtcaggaccctgcaggaaatagaaccattcaggtggctgcaagaagaaagtttcatgaaaggactatttagggagacttgggcaaggttaagattacaaataaggaatgtggaagcacctagggccttgcaacagcaggaggcggttaccgtctgtaaagaggaagaagcaagcggagggaatagtttggagcctattgagagctggggctaagaaggaaggcatcgccagcaggaaccatggtcctggagggatgaaccgcttcccaaatagcagtaccgaggcagggaggaagagggggaagaaacaccccagcttctcttcacctctcccattgcctgttggcctcacccactggctgaacccagctggaaaccagaaggaccagatgatgaattctgtaagggtcagccttttggggctcagctcacagcagaatcagagagaaaaaaatggatctgagaggtgaaacaaggaacaagcagcacgtaactctcagcttccctaccttgaaagtggaggagaatgagataactgaccttggaaggttattgggtggctcatgtactctcgaagggaagggcctggtcaatattaagtactcataaatgctgagattcagtgtgggtttcaaaccgtttctaggagctaaaggtcctgagaaagggcttcagtttcagtatcaagagacattctcaggtgggcagatctcttgaagccaggagttcgagaccagcctgcccatcatggtgagaccccatctctactaaaaatacaaaaattagctggatgtggtggtgggtgcctgtaatccaagctactcaggaggctgaggcaagtgaattgcttgaacctgggaggcggaggttgcagtgagctgagatcgcgccactgcactccagcctgggcgacagggtgagaccctgtctcaaaaaccaaaaccaaaaagacattctcctccttcccctgcagtggggcccactgggaatggttgcatcttccatggggagtttaaagtgaatgtgtagtggctaagagcaaagaccctagaaccaagtaggtggacactgtggtagtccatcagtgtggtagacactgatctttctgttactatagattaatggccttgtacagtatgcactattttgtgtctgccttctttcacttaaaataatgtttttgagactcacgcatgcatgtgcctgtattggagtctattgagagctggtttccagtcctgattgccactgacagtcaagttacttaacttttcatgccttattttctcatctgtaaaatgaggatgttagtagtttctacctcattgggttctgaggattaaaatgagttaatctacgtaaagagcttaacacagtgtctaacacatagtagacaatcaatagatgttagctattgtaattgccatcatcgtcatcatcatcatcattatcatcatcatcgtcaccatctccatggatcagctcaaatcaaaactgacccattgtcaatagaaaaattctctgtgggatgaagtccatgccaccaggcctctcgggaacttcattgatcataccattatcttctcatcctcccacagatatgatatttcagggagtgattgataggtgtgtgtgtgtgtacgtggggaagggtgggcttgtgcctgactccagggacagagtgctttgttatgcagaatagcttgcctgtcatcccactacaggccccttccttgaaaagttccaggctatttttgagccctcatggctcacatgttcctttctacatcatgtcaatgccagtacagaaaaattgaaaccttttggcagcatctaaagcaaaagagatttcaaagtgcatggaggatgagtgttgctcaaatgacagggtattaaaacgtgacaagaaggctgagttaagagactgcaggcagcttgtgtgtttgtatttggaccttgctggatttcttgggaaatcagtggagttgtccaaggttaatgtcatctccaagaaggcaccaaagggtagtaacactccttcaccctcatttgtacatacactctgcaagagcggaagatgatgcagccagtggagtgggcggttgtcccagagcaccacctgggctctgagctacaggattctgcaggggaaagcacctgaggacagagtgaggtgggttggtgccacctgggagctccaggcttttgtgtgctgatgtgcaggcagatactggagccagaccgaattgtgtgcgaaatgtgggtctaagagtgaaggcaccaaaccctcactttttttactttcattcagccttcccatttttcttcaaagggcagaatatgactttggagtcaggtagacctgaattcaaatccctcttcttcttcagtgagtagctaaatctttccaatgctttatttaaaaggaatcacgatcacactttcagggttgttgagaggtttagagattgtggtgttacagggcccctggggctcaaaaggtgtttgctgaacccctgtcttgtgttaaatagtcacaatagtcccaaggggaggatgaacaggtagcactgccatttcataaacaggtgactgaggtgcagagtggcttatccataatgacacaggaggtgaatgctggagctggattgaaggctgagtcattggactctcctctgagggaggcagtacagagtagtggtcagggcttgaccaacctctagagtccatgggcagattttctgggcctctggcttagttttcctcatgcataaatggaatgtggggattatagtagatgtactttctatggttgtgaaggttacatatacatgagataattctataaattcttagcatgtgcttgagttacagtaaatatgcaatgaagtattcactactgttttagtattatttttattagaagccgtggcagtagttaccatcattgtcaccatctccatcgatcagctctaatcaaaactgacccattgtcaacagaaaaattccctgtggatgaagtacatgttgtaggtgtagcgggcaatcgtgatcgccatcagaaattcatattggggtttggtttacaagtgttggcctctgggagtgtttcctacgtgctccttctctcctcccctttgaggacggatggtgtgatggttcctctccatttggtccctcctctgggaccagcattctcctgccttctttgtcctactctgtgtcccaggaggtagacccctgtggactgtatctcctggactcccttgctggttgacttttgtctgagttaagccaaagggaggtggcagcaagagacgagaaggtgggaggagagagagtttggggtatttccacctgcagctccctctgtccatctctggccccgctctgtgatgctagcccccgcgaggttgcccatctctcagggtttcctctcttacttgcccctgttacgtcatttcatgggactatacctttagctttaggtgcagaacagttttccacagttaaatgtctttaattgaacatctagaatgcaaaacatattataagataatgtgttggattgttttcctttaaaaaatggtacaaccactttgcaaaacaatggcagtttcttattaagttaaacatagagttacagtatgatacagcaattccactcctaggtatttatccaagaggaattaaattgtatgcccacacaaaaaatgaatgaataaattaagacttataaatgaatgttcatagcagctttattcataataaccagatactgttaaaaaaaccccagaatattgatcagtagatgaatggataagcaaactttagaataatcatataatggaatattattcagcagtaaagatgaactaactgctaatacagacacgtgcatgcgcgagtctcaaaaacattattttaagtgaaagaaggcagacacaaaatagtgcatactgtacgaggccattaatctatatagtaacagaaagtggatcagtgtctaccacaggctgggggtgtgtacagggaaactttttaggtggtgcccatgctctgtatctcaattttggtggtacatgcgtataatacatttgtattgtcttgtatcaaagtatgcctcatgaagttcaggtatatgaaaatttgtatttgctttattatatttaaatatcagagaatgcaaaattgtaaaaagaaaaagaaatcctgaaagtccttttaactagagacaaccaccaccatccacattttatctatttcctttcagtttttaattttttcctgtacttaggttttccccttcactgtcttatttaaataaaaaagaaagcaaatggaaagtctcccatacgaaggcctttttgctatgagtttaccttgtctaagggcatctagcatgatggtgagaaggttttgtcttgtataactaaaatgtattgggaggaaatgaaaatgtttagcctggtgaaggggaaacattggggagaaaagtgagggagagtgtggtctacagtcgtgagctttaaatcacaaccaatcagccaattaaatactgagctcctgttatgtgtcagtattaggaagacagtagtgaacaaaacatatggctcctctgatttaatggagttaacagtctgggagggaaagatatttttattatttgcaacaacaatagtaatagctaatatttatgatgagctagtgcctattatggtgttaaggtttagttttttcttttagtgtttttaatgtgttgtcacatttaatcccagcaactccatgagtaggtactcttaattctcatttcatggttgaaaataataaagtggcttggagatgttaagtcaaatggggtcatacagtgagcatgttaaacctagactggcaggtcaggacggaagtgatatttaatcctcagtgaaatgatttttttctttttaatttttatttttattgagacagaatctcactctgttgcccaggctggagtgcagtggcacaatcttggctcactgcaaccttcacctcccgggttcaagcaattctcctgcatcagcctcccaagtagctgggattacaagcacccgccaccacgcccggctaatttttgtatttttagtagagatggggatttcaccatgttagccaggctggtttctaactcctgacctcaggtgattcacctgcctcggcctctcaaagtgctgggattacaggcgtgagccaccgggcccggcctctttcagtgtttttaatgtgttgtcacatttaatcccagcaactctatgagtaggtactctttttattcctactttatggttgaaaataacaaagtgacttggagacattaagtcaaatgggaacatacagtgagcatgttaaacctagattggcacgtcaggacagaagtgatatttaatccccaagaaaataatatattttttttctttttttgagacagggtctcactctgttgcccaggctggagtgcattggcatgatcacggctcactgcagcctcgacctcctgggctcaagtgatcctcccaccccagctacctgggtacaggcatgcaccaccttgccccgctactgttttgtgtttttgcagagatagggttttgctgtgttgcccaggctggtctcaaacacctgggctcaagcaattcacctttcttggcctcccaaagtgctgggattacaggcgtaaggcactctgaccagctggaaatgatatttaatctgatatctgaaggatgataggagttaaacaagaatcaagtgtcagagaccagagatatgaggtctcatatatatatatttgctcagggcagggggctggttttgggtgataattaggggctagactgaacagaattagtgtttggaagtgagtggtggtggtggtgagggaggagagaagggtgagtcccagggtaagggatgcaggcacatcctgagaaatgaggcagaagaatgagaacttggcttggggcatgttctgttcatctgaatggtggtgctgaggagacaggtggacagagaggtgtggggttcagggaggagcacaggactgagagggaccagcaggaatagaattcctgaagtcccttggattgacaagatgcttcagtgagagagagtccacagggtagagatcagcacctaggacagagcctcgagaacttcctctaggatagggaagggctggagaacaggaggaggagccaaggagaggaggaaggggccaagagggcaggatcaggactgaggcaggccgacttctgcgcagttgaagaactctaatgtcagagctgtccttaggaggcagagaacccctcgtcctggaagagtgcagggagctgcttggtgaccatcctttggggatgtcatggaaaagatatttgcatcaatctggggtgagattaggtgtctggattggttcaggttcttttgtcatttgtaagcacacaaaagaactctagttatctaaaggaaaaaaaaaactggaaatattatgggttggcacacgagtggtgccaggcctcagagagtacagggcccagggtggctctggggatctgggtggcaggagcgaatggatgaccttcacagggtgacaccatcgggaggaatcagctccagctgttttctgtccttgtcccaagaatcaaatcccagggagaacagtgtgattccccaatgttgtgaggttcagtcatgtgcaaggggaaagccgggcacctcgattgacagccccaccaggactgcataccgtggagaaaggatggcttcccaaagaaaaacaacattccagctaccagagaaaagggagtggacgctgggcaggcaaagccaacagacactttttgtagtctccatggtcctgtgtatgattcagtgatttttgcagtattcacttagcaagtcattcctcgttgcagaattgttgctagtgtttttcctggctggggattaagctttttccatttgcctattttagagtgagttgggggcctgggattgacacgcatttgtctctgggcttcaaggtagcccagagattatgccacctcaggaggcacaatttggtggctgtcactccttgtcatgtcaacaaagggtgtggcttgtggctctgtggcctctgctttaccagcaaggggaggatgctggtagtagcaaagggtctaaatcgctgttgcatcagcgaggtggatgtgcctatcctaaaggcacctactgagaagatgcccaagtaacagacactcatgggcacagtagacctgtcaaacctcatagttcctggctgactctctttgggtgacctgagtcacacgcccacgcctgaacacccactgaaactcctaggtgcattacgtcttctgcaatatctaaaggaattaagggaaggatgaaactctgtatctcaactttcctgaattcaccagtatggactgatggaattgagtgctagtaacaccaagctcctaaataataataataaaggcttacttataggaacgtacgaagcacaagagaaataagggcccccacggcccacccttcaacttctcacatttggtttgttagtcaggactcctttggtcacaagagacaaaaaaaacaattcaagttggtttaggaaaagaggcatttattggcttgtacagaggagttgagagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaataaatttggtaacattataaaggaaaacagtcttttccggcagttgctgaccactgcaaaattactgctctttcttttgtttttcctttttagtgctgggctgtgaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctggggagccaggactgagaactagtgctgtagaattgtatatgggcaaaacagcagggatctagataaaaaaagaaaactgaagtagggaatatctcagtccgtacctacagatagcctcacacatgtggtcgcgcatacagagaacgtctctagaaggatacacaggagactggaaagaacggttctctccagtgatgaagtacagtggtgattctcaactgtatactcgtttgtaatgttggaattttgaagccacaagcataaatgctcactgtgtactgaaagctggccagacagggctgtaagatgacccctgaactctagcttgtctgtgttggggccggctgcccacagattcacacaaaccatctccctgcccgtggtctctgcttgccctcctctactcagctgcaatgagtggtttccgagtgtgggagagaccagaagagctcattcattcattcattcgctcacatttttagtaagaattaggtataagccaggcacgtggtaggcacgtgaatctgatctcaccttcacaaccgtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtcctgtggaatgtgccatttctattccaatctggccctctgtctgctggctggaaaaccaagctcctttgctttaagtttcatttgtggactgcatgggatgggctgtgggtattgatttgtttgtggaaaagatgtgcacaatagggaatgtgtaaaatacatcatggaaatggatggttaatgccgcctggctggagtgtggggcagtggagtgacaagagatgagagtcaagttagatggtggggtatactgtgggtagatgccgggctaagcattttgaactttaacctttaggctactgctgtccaataagactttctatggtgctggaaatttcttatatctgtactatccaatgttgtctccagacgcatgtggcatcaagcacttgaaaagtagctggcatgaatgaagatttttattggcattttagattttatttaattaatttacttttacatagctccatgtggctggtagctaccacactgggcgctgcagatttaggcaatagcagtggatgtgttggagcagggaaataatatcaaagctgaatcttcagaaggtgatttttccaggagtgtacaggccgcatggggtgagcagaagtaggtagggataatattgacacttcttagcatctattaggcacttcttgtgtccacacactgtgctaagataactcacttattcctcataacaactctatgaggaaagtactatcattgtccctattttatagactagaaaatgagacacagcaaagacaatgggcatattcaaggtcacacagctaatcaacagtggcacacggtgtagaatccaggcagctcagctgtagagcttgtaccatgaatccttccatcctggaaggaaataaatgaaccttcattgagaatataccttctgctgtcccctggtgctgggcattcacacgtaaaatctcatttagatttttgttaacactcatgtgccattcggtggatttagatcctttgtgtttatggaaacttgggctcatagggatgagatatcaaggcaactgcaatctctgtggacaccagttaaggctttattgtaaaattccatgcctgtgggggaaatcacaggctgtgggagtcggggggaatgtacaggaagatatggcataaaaggtgttgcgaaggaagaatcagtgggatttagcaactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggcaggaggatcacttgaggtcaggagtttgagaccagcctgggcaacatagtgagatcccgtctctagaaaaaacttaaaaaattagccaggcatggtgatgcatgcctgtagtcccatctactcaggaggctgaggccagaggatcacttgagcccaggagtttgcggctacagtgagctgtgattgcaccattgcactccagcctgggtgacagagcaagactttgtctctataaaagatataatgagaatcatagcaccttcctcacaggactgtgatgaggctcaggttaagcacggatatgaaagccctttgcaaactcaatagcatgaccctgtgagtcactcttcttagtgctggtgagaccagccattgggcagaaatggtgaccagaactttctgtctttgatcatggaaacagttcgggaaattgcctgggggaaccccacttcatcttaggtacttggtagagtttaatgcggataagtctgtgggtcagctttgacctaggaggaaagagtggttctcccagcagctgtagagcaaaatctgcatgccagtggctccaacttaaatgcccttttccaccaaacagtttgcatgtgttgtcttatttgagctgcacaacaaccttatatacataggtactgtgataaaataaggctcagagaggtggagacactgagctaatgtccttcagcttataggtagtaaaatgagtgttcaaacgaaggtcctcctgcttccagaaacttagcctgtaattcctgtaggtgatgggcttctcatttcttctcctaccacagatatctgcaactagcgctagaatttctatcccagattgacatggatttaagggtaaaggttgcttcctaagaatgtcagttttccactatagaccccagtaagaattgtgtacaagaggggaatcgactccaaacagaatatatatatatatatgatttaatttagtcctctttggaatgcaatgagtaaattttagtggttagagtaaaccactaaaatttgggagttaggggtgaagtgcagtgtgaagcagagttgagatctcagtgcttttcctggggcagaaacatccgagagggcccctgtcacccaagcttttggctacagtctactccttccatctgggattaaccaggcgtttcttatccttgctgatctagtgtttcttattgctgctgtaacaaattaccacaaatttcctggcctaaaatggcacacatttattatcttatacttctagatgtcaacattctgaacagcaggtcttccggggctgaaatcgaggtgtcagcagggctgccttccttctggaggctctaggggacaatctgtttcttaccttttctagaggccacccacattccttggcttgcgttcccttccagaaatggcacaattccaacctctgcttccatcatcacgtctcatcctctgactccgagtctcttccctccctcctataaggacccctgtgatcacactgggctcatccagataatctagtataaccccctttctcaagatccttaatttaatcacatctgcaaaatcaattttgtcatgtaagtaatatattcacaggtcccaggattaggacacggatatctggtggtggtgtcagggggtcgggggtaggggatgggaacattattctgcctacagagctggcaggtggcctttcttctttcctttcttttcctttcctttccttcccttcccttccctttcctttccctttcccttcccttttttccctttcttttctccttcccttccttttttccctttctcttccccttccccttcccttccccttcccttccccttccctttcccttccccttcccttccccttcccttccccttcccttccctttcccttccccttcccttccccttcccttccccttcccttccccttcccttccccttcccttccccttccccttcccttcccttcccttccccttccccttcccctccccttccccttcccttccccttcccctccccttccccttcccttccccttccccttcccttcccttccccttcccttccctttcccttccccttcactttcccttccccttcccttccctttcccttccttttcccttccacttcccctttcccttccacttccctttcccttcaccttccccttccctttcccttccccttctctttcccttccctttcccttccctttccttttcccttcccttccctttcccttccccttcccttccctttcccttccctttcccttccccttccctttcccttccctttccctttcccttcctcttcccttccccttcccttccccttcccttcgccttcccttccccttcccttccccttcccttccccttcccttcccttccctttcccttctccttcccttccccttcccttccctttcccttccctttcccttccccttccctttccctttcccttccctttcccttccccttccctttcccttgcctttcccttccccttcgcttctgcttcccttccccttctcttctcttttcttttttttctggagtcagggtctcattctgttgcccaggctggagtgcagtggtgctaacacagctcactacagccttgatttcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtcagagggctgcaggctttcaacctttgtagagcaaggggttattgaataaattatgaagcatctggagattctgggctcttaactgggtacctgtttgaaagtagggtctagtacatttttttcagtagctcagtaaatgttgcctcttcttaaaaaaaaaaaaaacagaaaacaaaaactggtcttactctgaatttgccaaatagaaatgagggggcgtttatttgtgtcacaaaaggatttgatttctttaaataggcagccctactattttcttcaaagtgttttagttaatgggaaatttgatttgcacaacttttcagaaacacactgtgtaaaggaattacctgcaccagaagctcatgaggtttttcaaagtctgttctcagcttctctgcacatcatgctggggttcacttggcctattgattctgcctcagtggggatggactattcatttctgtgggtaattggaagcctacctaaagtgaccttgtcaatggttggattgacaaatatccaggctggtgggatgtcaggcgatcatccaggagctacatctaccatgaagttggttatgttttctcctttttctatgactgatgatattcattttttggttcattcattcaccaaacatttatttactgaatatcaattatgtaccaggaattgtggtagacactaggagactagagatgagctatctttatccccttctgtctccaaaggggataaagatgaataagataataattgatttttttttttgagacagagtctcgctctgtctcttaggctggagtgcagtggcgtgatctcggctcactgcagcctctgcctccctggttccagtgattctcctgcctcagtctcctgggtagctgggattaccggggcctgccaccacactttgctaatttttgtattttttgtagagaataactgatattttagatgtttggaagaaaggttgtagaataaagcacctacttgaaaatgggggaaactactttcctaaatatttctgggtcaaagaataaattaaaaccatactaatagaccacttagaaacttgatacaatgatgggactaaatataaaacataggatgcagccaaaactgtacttaaaagagggtttttagccataacatctttaaatgtttaatgaagaggaatgggaataaattaattgagcagtcaattcaagaagctttaaaaagaacagtggataatattagctgacatttgtagaatagtcatgatatggttggcatggttctgggcatggaataactcatttagttctgacaacaccactgtgatatgggtcctattgttgctgtcattttccagagaggaaactgaagtacaggaagatgaggtagtgtacctagtcttagagtttgcaaatgatagacacaggatatacacctgatcatcagactccagaattcacattcccaaccaataagtaatacaaatacaagtaagcaatacaatcacagacacacagaacaaaaaaagttaaagtagcaattaataaagtaggctaaaaccaggtagagttgataaatataatcataatctgcttctttaacatgatagaaagataaaaatagacaagaaagaacacaaacttctggaaaaaaaataacgagagactacctaacaatgcaatatgaagaaagaaacaaagaaagagaaaaggtgtaatatcatcccagataagatgctacaatttaaacacgttgagaagaacactgtggataatttccaaggaaaatataaattccaaaagtttgtttgagtagaggtgaaaaactttcctgtgtggttgaagtgtagagagggagagggaggtgaagctggggaaagctcagggatggggcgagactatgctgtcatccctttactttcatgttgaataaaagggaaagttaaacatggaactacgacagggggaaaagagagaataataaaaatattatttggggtaatacggttttctatctggaaaactcaaaggaagcaactaaaactccacaaaagctatttgagtttttttaaaaaatgctttaaaataaatatgctaacaatctattgctttcctattgtttttgtttgtttgtttgttttgtgttttgagatggagtctcgctctgttgcccaggctggagtgcagtggcatgatattggctcacttcaacctccgcctcctgggttcaagcaatctactgcctcagccttccaagtacctgggactactacaggcacctaccaccacgcccagctaattttttttgtatttttaatagagacggggtttcaccatgttggccaggctggtctcgaacttctggcctcaagtgatctgcctgcctcagtctcccaaagtgctaggattacaggcatgaaccactgcgcacagctatttgctttcctatttttaaacaatgaccagttgggaaacaaaatgaagacatgtcaaatttacaatagcataaaaaagaatcccttagatgatgctaaagggaaaatgtgtaggacttatatggagaaaataagagttcaacaaggggacaatcatttcctgatggaaagactcattgttgtcaaggcatcaattatcttgaatttaatttctaaatttaacacaatttcaatcaaagtcccaatcattttttggaggctgagggttgactgaatacaatcccaataaaaattccattggtatttttaaaatcttgataaactgattctaaagtttacttggaagaataaatatgcagtgatagccaagaaaatgttgaaaataaggataatgagggtggacttgccctgccaagatataacatattacagagctactataattaaagcccatattgctatactagaagacagatcagtggcacagaatagaaggcccaaagacagaccccagtatatataattattaaacatataataaagttggcatttgaaatcagtggggaagggatgaattattcaataaaggatgctgggacaattggttacctctttggaaaaaaatggcaaattggattcccatttcacatcagattccaagaaattagacatggatcaaagagtttaaagtggaaatgatgccatataaaagtacaaaaaaactccaaagagtaatatttatatgaccttggagcatgaagaaggctgtttgaggtgtacttggactgtctttctttgtccagttttcccttttagtggtttaaaaggaatacatagtagtttttatatttttatttatttatgtatttatttttgaaacagggtctcattaggtcacccaggctggagtgcagtggtgcagtcatggctcactgcagccccaacttcctgggctcaagcgatcctcccacctcagcctccggagtagctggactgcaggcatgcaccaccatgtctggctaatcttttattttttgtagagatggggtctcactatgttgcccaggttggtcttaaactcctgggctcaagtgatcctcctgccttggtgtcccaaagtgctgggattacagatgtgagccaccacacccggtttctattcttatttttaatacttaattgttaacacgtatatttaaacttataatgtcctatatgcaatttctcaatatcaataatcttttgaggaatataagactcagcacattttcatcttgtaaccctcctgcaactcccatttcttatgacttgggttttctctacttctctatctcttcctctgttgaaaacttttcatattatggaaaaaattaaacatatataaaagtaacattagtataatgcatccttgtgtatgcatcacccagttcaataatgacccatcatgatcaatttctttttcatctgtaatcctcccctttctctccccaccttggcatactgaattattttaaattattttatccataaagatgttaatgtatcctcaaagataaggattctataagcaaagaaaaacaagaccattatcacaccaaatatttttcattccctaatatcagtaacaataattcccttatgtcatcagaaagtgagtatatccatttccctgattgccttacagttttttaaactgttggtttttttccacttagaatccaaacaaggtccacatgttaaatttagttgatatgggttgataggtgcagcaaaccaccatggcacatgtatacctgtgtaacaaacctgaatgttctgcacgtgtatcccagaatttaaagtaaaattaaaaaaatttagttgatatgtttcttaaattcctttgaaaatatacgtttctcgtcctattttctccccacttgcagtcctctcttgtagtctatttgttgaagataccatattctttgccttgtagttttctacattctgggtatttggttggggtgggggggggtgtgtttgctgatcgcatccctgtggtgtcatttaatatgttcctctgtcacttgtattttctgtaaatctgtatttgcatcaagagacttgaaccaatcatatttgattatttgacaagtgtacttcataggtagtgaagtgagctttcctctgtaggcaagtggtatctttttgtgaccttagcaaccatagatgaatgtcacctagactcattgtgtcactagggatggccttgaggtttcctgttctattttcatttactaagcatgcactttagaaaggctctgagctgctccctgaagcatggcacccgtcctccagaaacccgcagtctagaggttgtaaaagaagatttgaacaccaagactgtaaaagatgatttgaacaacaacaacaacaacaaagcagttttattttgtatacattctttcattgtacctcccccagagggatataacctccaaataggggagccataccatagatgcattaaattcacaccaattcaaatgtgtgtatatatgtatttgcttgcagactactaaagtgacaatgtaaacgttgctgcctatttttcccactcttctattagattgacgttgcttttggtgagatggggcatgagtccaccatcctgtcccctctgtttccacatgaccctcatcgtatgaacacctctcttaagtgtgattctaggatttaaagatacatatttcttatgcattatgcacctaaacacaagccaactacttcatctggcacctgatccaagaaacaacattctgttccaaaatcaatagaagacaaggcactttaagggatcttcaagggagtgtaattttgagcatatggaatctttctaaccctagctaactttagaagtttaactcctatgcaagatgaagcatctatgttcccaagagtttgacttcagcaaaggacaagctgcagaagctgacattattgtttattttggcataaaggctttacttgttggtgaagttcaagtttaatgatctcttcctccctttctctctcttcctcctctccgctttccttcttcccttcctcccaccctgattttctcttttgcagtttgctgctttgtggtgcacaagcggtgccatgaatttgtcacattctcctgccctggcgctgacaagggtccagcctccgatgtaagtaatgggcatcgattgcttttctctgtccacagtcaatgctgccttgtgattaaatgtgagtgagcattcttagacgagtaagtgtggacgatctcactctaaggcatgtggtggtccctatagcttttgagacagttttccttttagtggaaaacaaaattttggagggagtgtggctggataggaagtcagctagtttgtctactatgattttgctaatgtcttcactttgagagctggagcacggagggtgagaggcaggggcctacttggtagtgtggctgcaaaaaggtagtttcggtggtactttgcagtgcacgttatggcactttgttagggtgttctttcttttgttattgttattattatttttattatttttcagatggagtcttgctctatcgcccaggctggagtgcagtggagcaatctcagctcactgcaagctccgcctcctgggttcatgccattctcctgcctcagcctcccgaggagctgggactacaggcacctgccactatgcctggctaattttttgttttgtatttttggtagagacggggtttcaccgtgttagacaggatggtctcgatctcctgacctcgtgatccgccgcctcggcctcccaaagtgctgggattacaggtgtgagtcactgtgcccggcctattattattattatttaagagtgttgcccaggctggtctcaaattcctgggctcaagcaatcctcctgccttggcctcccaaagtgttgggattccaggcgtgagccagtgcaccctgcttgttagggtgttcctaatatcagggcccaggaatgaggaggaaatgaatttatcctgctaccatgaatctcaaagtatgactactgctagtgggacaagagatgcttgtaggtaaaatgtgcaaaaaatttttgttttaatcattataaatgtattttaatgtggattgggaaaaatgtatctagtagtggttttgcatttatgataaggatatagaatttcctacctaagtaaagatttttaggttaaacaaaagataaactgatttgaggacaatattaagtgaatgacagtatgggtgatataaggatatggcaaaagttttggtacaaatgtgtttaaagtttagggtacattgttgattggcctacccagcagccattcacagccttcatccttctggcagaggctacctctcatgatggaagctaaaaatgcctaatacttgcttttcccggctctcttgtagctgctgaatgaggatgtgacccaatcctgctaatgggaactgaggggaagacctgggaaagagtctaggaaagatttttcctttctgataagagagagacatcccttcccttgtcctcttgggcatttttgtacaaggatataatgcttggagttgtggcagcccttttgggtcaatgagggacacattgccgacatcctgagcatggcagagtggaaaacttaaaagaaccgtgggtccatgatgatgctgatgagctgttgataccactcacagtccttttatccccaagctggatagatgggagaagaagctttttttttggccaggcacggtggctcacgcctgtaatcccagcactttgggaggctgaggcgggcagatcacaaggtcaggagatcgaaaccatcctggctaacatggtgaaaccccgtctctactaaaaatacaaaaaattagccaggcatggtggtgggcgcctgtagtcctagctccttgggaggctgaggcaggagaatggcgtgaacctgggaggcagagcttgcagtaagcggagatcgcaccactgcactccagcctgggcgacagagtgagactctgtctcgaaaaaaaagaaaaaaaagaagctttttttttttttttctttttttttttaagcaaagtcttactctttgaagccttctcttttatttttgtttttttctcttttgagacagaatcttgctctgttgcccaggccagagtgtggtggcatgatcatgtctcactcactgcagcttaacctccctggctctagcaacccccccacctcagccgcccacgtagctgggcctacaagtgcatgccaccacacctggctaattttttatttgcttgtaaagataggttttccctatgttgcccaggctggtctcgaattcctgggctgaagccctcctcctaccttgacctcccaaagtgctagaattacaggcatgagtcactgtacctgaccctgggggcattcttttacatgcagctgaaactgtcctagctgagaaggctttccaccatgcacagtctttcattgcccaataatgaactgcattcagcataccccaatgcagccatcacccctagttctcttactttgtttctgctttgaatccccttcttgaaatttctcccattggctttgtctccattactggttctgttacccacttagacttgacagctgacagcttgcccaaagtgagtagtgactatcttctgtcattggatttctttagctcctgctggtcttctgcaaatggtcatctgccaatttgctgcaaactggggtgggagtttgtggggagggcatatctgttgccatagcaacacaaagatgctggagcatatgttggatattctttgcttggaaaatgtggtaattgaggttaagaactccaagaaacatggaacaaccaaagtccttggaaatctgtttgcaaagacaaagtttgagactgtttgtcatgttctctcagatcctatgccctagcccttgtagtgcaatttcttctctcctccctagcaaaataggcaggggagtttggggagactgccctactcagtatgcagctctgagtgttcatgcagactgaaacttgatactcaacttgcagccaagaagatggtgtttcccatattctatctatctgctgaatgtttctgttgcctaagacagaaactcagctcaaactgacttatatgaaaaggaaaattttgggtccttgaaatagaaaaggcctaagggttgacttggcttcaagcacagtgaatcaaagttctaaataatgtcctcaagaacctgtttctccccttcttggcttagcctttgtctgtgttgattttattttcaggaaggcttgtctcctatgcgagcatggtggctgcaacacctttaatcttatatcttatcagtgctgcagtgcagtaacaagagctaaagtctcattagaccatgaatcacatattgccagaagaatgggttatgctgattggccaggcctgggtatatgctgctgtggtgtgaatgttttgtttctccaaacttatatcctgaaatcctaacacccaaggtatggtgttagaaggtgggccccttgggaggtgatcagttcatgggggaagagccctcataaatgagatagtgcccctataaaaaagaccccagagatatccgtcaccccttctaccatgtgaggttgcaatgagaagacagttgtgtatgagaaagtgagctctcactggagaccgaatcttccagtgccttgatcttgtactttctagcctccagaactgtgaggaataagtttatcatttaaaaatcactcaggttttggtattttgttacagcagccagaagggactaggacagaaaattttggtactaacagtgtatagaggaacaaaattttaaggatgggttttctgaattggtttcggggatttggtaattggctgccaaatctgattagatttaagaatgctaattaccctatttctagtagtaaagagagcctggatagtccgtggcatgatctgtttatagagatacacaaatcatctgcattggatactcctaatcaaccatttataagaagcaaggagccaagtgattcgatatatgatacccaaacacttttggaaaactaaggcatataatgacttgctcctaatgtctctggacaaagtggagaaagaaaaagatgagctcagggatttgaattcccagctcaaagagtttcataaatgatctaagagcttctaggtgtgccctgaaggagagccttctagcctgtagttgcagggctgaaatttctgaaaattaaatgcacaacctcatcctgcaattggctgaattacaatgcaaattggactccccaccacacagggtgtctgctctaaaagcaagggcaagggcattgatcagaaaagaatgggatcccataaggtgggaagactctgatgaagaccctaatgaagctggggacattgagcccctaaattctgacaagtcttttttttaccagtggaagtggcctccttacctcaagcaaaagtgtcatccccactcagggtggcattggcctttccatcttgtctaagggaactaaccctgcattgccctaagaaacagtaatggctttccctgaggcagttgccatgccaggcaatgctgattcttgtcagcaccgaatcccaccaccccttcaagtcctagcaggctcctaaacgtgagatgcactgtgtgacccacggggaggtatgctataccccaaaagaactatttgagttttctaatttatacaagcagaaccatagggaatatgcatgggaatgatattaagggggtaggataatggtggaagtaacatgaagttgaatcaggctgaatttattgatagaagttcactaagcagagattctgaatgtaatgttccagcttaaggagttaggaagggctctaacagtttagctggttggctgaaacatggattaaaagatggcctatcatgagtgagttggagatgcctgacctcccctggtttaatgtagaggaaaggattcaaaagcttagggagattagaatgccagagtggatttgtcatttaatacccgctcacccatgctgggaaggtcagacatacctttaagaaaggtatgtctctgtcaatactttgagaaatatatttgtgaggggagccccagcgtcctttaagagctctgtgatccctcttctctatagaccaaaccttactatgggaaccacagccacttaattggaaaacttaaatgcaatgggaataattgggtcctggagtatcaggggccatttggtggcactcaactgttaaaggcaaggtaggtgcggttaccttaatggatcgcagagttacaacaacaatcggaatagcctgactcatgcagacctatggcactgcctaatcatggtgttgctagaagtgaaataggtgggaagcctactaaattcttacttgatctgtatagcagaaaaattctaggtgaagtgaacagaagtctaacttgaatcataaaaatagagaatcatagcccctcagtccattcccagacttgagccagtttatagacccagaaccctttgaatgaaagggaggtaaaatttccttgagaaagcgattatactgctaaaagtttatcctgttaatctttctcccagccttgcccaaagggacctactgctttttatcaggataactgtgcactagagaaaaggaaatgatgagaccttttggggactactgaacactagttctgaactgacactgattctaggagacctaaaatgtcacttgtccctccagtcagaataggggcttatggtggtcaggtgatcaatggaattttagctcaggtctgtcttacagtggatccagtgagtccccaaacacatcctgcagttatttccccagttccagaatggataattagaatagacatacttagcagttggcagaatccccatactggttctttgacctgtagagtgaggcccactatgatgggtgaagccaagaggaagccattagaactgccccagcctaggaaaacagccaaccaagagcaatactacatccttagagggacagcagagatcagtgccatcatcaatgacttgaaagatgcagaggtagtgattcccaccatatcccttattcagctctcttatttggcttctgcagaagacagatgaatctagaagaatgtcagtggataatcataagcttaaccaagtgatcactccaagtgtagctgctgtatcaaatgtggtttcattggttgagcaaattaattcatcctctggtagctagtatgtagctattgatttatcaaatgcctttttctccatctctgtccataagacccaccagagcagttttattgcagctggtaaggctagcaatacaccttcactgtcctacttcaggggtatatcaactcttcagtcgtatgtcataatttagtttgcagggatcttgatcattttttccttccacaagctatgacaatggtcctttacattgatgacattatgctgatttgtcctagtgaatgagaagtagcaactactctagacattggtaagacatttgtgtgttagaggatgggaaataaatccaactaaaatttagggaccttcttcctcagtgaaatttctaggggtcagtggtgtgtggcatgttaagataccccttttaacgtgaaggataagttgttgcatctggacccttctacatccgagaaagagacagatggcctactgggcctacttggattttggaggcaacacattcctcatttaagtgtgttatgctggcctacttaccaaggggccccaagagcttctggttttcagtagggcccagaacagtagaaggctctgcaacaggtccagactgctgtgcaagctgctttgccacttgggccatctgacccagcaaatccaatggtggttggttagtggcagagagggatactgtgtggggcctttggcaagcctttataggtgaattgaagcacaagtatttaagattttggaatatagtcctgccataatccacagatagctagtttcctattaagagacagctcttggcctgctaccgggccttcgtggaaactgacgatttgaccatgggccactaaattgccgtatgacccgaattgctcttcattaactgggtcttatctaaaccaccgagccataaagtgggcatgcacagcagcacttcatcatcaaatggaagtggtatgtatgtgatcaagcctgggcaggctctaaaggcacaagtacgatacatgaagaaatggcctggatgcctgtgctccccactcttgctaccctgccttctctctcccaacttgcacctttgggctcatgaggagttagttccctatgatcagttgacaaaggaagagcagactaggacccagtttacagatgtttctgtacggtgtgcagacaccacccagaagtggacagctacagcactgtagtcactttaggacatccctgagggacaatagtgaagggaaatcttctcggtgggcagaactttgagcagtgcacctggttgtgcactttgcttgggaggagaagtggccatacatgtgactatatcctgattcatgggctgtagccaattatttgactggctgggcagggacttggaaggaatatgattgaaaaaattggtgacaaaaaagtgtggggatgaggtgtgtggatagacatctctgagtgggcaataaacatgaaaatatttgtgtcctaggtgagtgcttaccaaagggtgacctcagcagaggaggattttaataattgacttgatagaatgacccgttctttggataccaggcagcctctttccccagacaccctgtcatcacacaatgggctcatgaacaaagtggccgtggtggcagggatggaggttatgcatgggctcagcagcatagacttccactcatcaaggctgacctggctatggccaccgctgagtgctcaatctgccagcagcagagaccaacactgagttcctgatatggcaccatgcctaggggttatcagccagctacctggcggcaggttgattacattggaccccttccattatggaagaggcagcattttatccttatggaaatagacatgctggatacagatttgccttccctgcctgcagtgcttctactgaaactgccattcatggacttagagcatgctttattcactgttatgaaattccacacagcattgtgtctgatcaaagaaatcacttcaaagccaaagaggtgggcagtgaactcacactcatggaattcactggtcttaccatgttccccatcattctgaagcagctggcttgatagaatggtggaatggccttttgaagagtcagttatgttgccagctaggtagcaataccttgcatgcctgggcaagattctccagaaggctatatatgctctgaatcagcatctagtatatggtgctttttctctgatagccagaaatttatggatctgggaatcaaggaagtggaatgggagtggtaccactcattattacccctagtaattttaccaccagcaaaattttgctttcttttcccatgactttatgctctcccagcatggaggtctcagttccagagggaggaatacttccagcaggagacagaacaatgattctattgatagttaacactgccacccagccactttggggttcccatgcctctgagttaacaggccaagaaggaagttatgaagttggctggagtgattgatctggactactaaggggaaattggacactactctacaatggagaaaaggaaaaatgtgtctggatacaggagatccctaaagacatctcttagtattaccattacctgtgattaagatcaatgaaaaactacaacaactcaatacaggcaaaactatgaatggcccagaccctttaagaatgaaggtttgggtcaccctgccaggtaaggaaccaccaccagctgaggtgcccactgaaggtaaagggaatacagaataggtaatagaagaaagtagttacaaataccagctatgaccgtgtgaccagttacagaaacaaggactgtgattggcatgattattggcattattttgttatggatatgtttgtgtgtatatatacatatggtgagcaaatatctttgttttctttgctcttttagttctttatcatgtaacgtaagatgtattgactttatatcagtatttttatgtcttagtatttaagttataggataccaggacaagaggaatcattactcaaggacttcatctccttttctggggaggggattattgcattttcagttgtacaaagtctaattgtatcacatcaggtggaattatgtccttgttattctttatttggaggttctttatttaagaaggtgtgtatggatgccaagttgagaaagggtggacttgtgatggttaattttgcacatgcagttaaccttgactgggctaaggggggtacccagatagctggtaatacatgatttctgggcatgtctgtgagggtgttttcaagaaattatcatttgaatcagtagactgagtagaaaaattgccttcattgacataggcaggcaccatctaatctgttgaggactcagaacaaaaaggcagaggaagggtaaattcactctctctttttgagctggaacattaattttttcccgcctttgggtgttggtgctccaggttctcagtccttcagacgtggaccaggacctactccattggcacctatggttctcaggtctttgggctcagatttcaaacattggactaaactatacccctggctttcttggttctctggcttgcagatggaagactgtaggacttcttggcttccataattatgtacaccaattcacgttattgatttttttttggagaaccctgactaatacattgtgcctacaccgtagatgagggcgtgagtgccccttccatggattgagagtggggaagaggtagtttctctgaggaaagctagagaaacggtattgtgtcctggttaaaatcacggattatggagccagcattcctagcctcagatctgtgtgaccttggacaaataacttaaatccatttatgccttagattcctcagctaaaaaatgagttaaataatagtttctacttgatagcattgttatgagtatcaaatacatagatatctgtaaaagcacttaggacagtgtctggtgcatggcaagagctatatatgtgatgatgatgatgacaatgacaatgaataacagtgcacacatgctgagcagccagcaaggacaggtgtcttgtcagacagaccaggaaagggtgaagaatgagcaggttctctgtctgccacctggcagtccttcctagaagtgtggaggctctgtaagtggcatgagacccctctctgtatgaatgaaggagtgcagccattcattgccttgagcatgaggagagcaggaagtactccctgcagccagcatgcataggatttggcagcctacctgaaatgattctatctctggatacagttccaaaaaggtcagttggcaccaaggatgatgaattggtccagacacctgaactggcttgactcagttcattgacctttttctgctcatggttggaggcatgattaaagacctagccacacctgcttgcccacctggccagactctcctttagctgcccctgatactcatgcaggtatggaggggtgccctctccttctgcatgaccttggaggaactggtgtgcagcaagttcgtgaagcagaaacacacaggcggtgaccttggacaaggctccatccacgataaaggatgtgcttggttgcatcctctaccctctgctgttccaagcccagtctgagccaggcaatattatggatattagtagagctttgtgctgttggcattatcctacagctatgttcacatcatatcacattgaggcaattttatgaaccaggcactgtcccgtgaacctagctactgagccaaccattcaataacaatgagaatagacaacatttatgggcactcgccattggagggccacaaagtgtggcagagttcatggatgatgctcctggtcacccacagtcatccttcttgttcttgatctcaccaggcaggaaatcctcaattcatctgtctcttgtacctcttagagagaccaggtctctggtactgtcataagcattacttatggacattataggttattcagcactcagaatactgaccacatacacagcctcctgtgacatctcagaacaagaaacagaggagttgtctctgagggttgggactagggtgagtcaagtgaggtactttccctgggcacagtttaaggggttcttgtctgtgtctgtggatagctggttggttggctggtgggtggatgatctaagatggcccctttcacatgactgacgacgagcaggttgtcggcctgtgtgatttggctctcgtccatgtggcatcatcctccatccaactggctagctctgacttgttcatatggtggtttccaggctccaagaagagcaagagagcatctcccaacactttttaagcctttgtatcatgtttgctaatgtcctaaaaagctagtctctggccaagtccagattcaagtggtagaaaaatagattccagtgcctcattggagaggaagtatctatggttaatctattgcagatcctgttaacccaagaggccatagcagaacagaacccctggagaccatcacactggactttataaaaatctgcatgttatagtgtggctcagagtcatagatggcctcatcaaaagaatgcacctaatttattccctgcctcaatcgccagtggacttaaccacctctagctataagtggttaatgtggcagtttattgatcacgtcaatggtggttaagagtatggactctgaaatcagacatacctgaatttgagtcttgattctgcccagatactcattaggaaaacttgggcatgtcgttcgacttctctatgccctagtctccttatatgtaaaataggatgttagtaccaaccacataggtttatagtgataattttaaaaatatttaaaatgagaaagagttcacaaacaaaagacaaatgaatttcaaagcccttacatgaaagcgcttggcacagtgcatagcaagcccttggtacatgtagctaaggccatttccattgctccacctaggtccataatcaagaatgtactgacaattctctacattcttccacccagagcatgcccttatgaggtgattacagtttccatttccattacttcacacaaacctcaaattctgtgatgcagtgctaagaaaagaactcaaactttggagccagaaaatgctggtgtcaaattccaaatggtctctgctatgtattgctccaatgaccttgggaaaataactttaagttctgtgaccctcagtttatgtctttaaaatagagaaaataatacctaaataaagcggtttttttttttttggtaactattcaataggagactgcttgaaccatccctagaataatgtctggcacaaagaaggcactcaatacctggttttaaaatcattattaatgtctggaggagcctctcctgctctataagggatacaggttaccctctgacctgccaagaaataatagctaataataatagctaactttattgaacagggtctctgggcaggcagtacaaaaggactctttgtctggtttgtctaaagatacctttttcaacactttatggctttagaaataatttcttatgatttatagtcaagttactgagtaaaacccactgttaggtcctgtgatctcctaattccatcactaaatcaggtcaattagagatggtagacactaatgttgaccttatccttttgatcaagtctcactttgtgataagatagattaaaaatcataaacttgttaaacttgttaaatgttgaagatttgataaaacagaaatgaaagtattaaatgtatgtatacattaaagtatgtaaataagtgagaacatgtttgaaaatctggttgaaatggatgattttctcataaaattgtcaattttgtctcaaaaagaaattgaaaaccagaataggcaaataaccgagaaagaaatgaaaacattattcaaggatcttttcttctcgtaaaaccccagacaaatatgtttcatgggtaaaacttcttaaattttagagcaacgaagaatttctgttcatttaaaattgtacctgattacaaagaagaaataaacctttacaattttttttaaatgaaaatgagagaaatccagctcaaattagcagtaggaaaagagggcccattgactcctgagaaggacattgggagtagagtaagagcttcaggaccaaggacctcaaaggctggaactgaagctccagtacttgcaagatacttttccatttctgctttattggttagttattttgctctgtaacaaaccattccaaaatttagtggcttgaaacatcagttatttgtggtttctcatgattgtgtgggttacttgggtgattcttctgacctgggtttatttgggtaatccctgctgggctctgtcctgggtcttggtcagctagtggctgggccgatgctggattacctagaacagccttgctagcattgactgagggctggcaggctgtcgatctgggcatttcatttttcctccatgcgtcctcttttcctccaccaggctagcttagtttcacggttccaagcacggcaagagagggaaatcccaaagcacaggtgtgtgtgtgtgtatgtgtgtgtgcgtgcgtgtgtgtgtgtgcgtgcgtgcgtgtgtgtgtgtgaaatggagtctctttctgttacccaggctggagtgcagtggtgtgatctcggctcaccgcaaccctcccagatacaagtgattctcctgcctcagcctcctgagtagctcggattataggcacccaccaccacgcctagctaatttttgtattttttgtagagacggggtttcaccatgttggccagctggttttgaactcctgacctcaagcgttctgcctgcctcagcctcccaaagtgctaggattacaggtgtgagccactgcgcctggccagcataggtgttttttaagcctttgtttgtgtcacagtggttatggacaagatcagatttggggtggagaaacaaacttcatctctggatgggaagaatagcaaagtcacatggccaaggagcatgcggggatgggagacattggtggccattgtgcagtctaccacactgacccttatctgctgtgccagatgcctcgtttgcccttccaatccactctgctttctctgagagactaagccataatgactgcttcaactggggctcccttaccctctgacctgacctctggttggactcaaggggaggggctaataggagacttggggaggggagagtgagaccctccccgagtcagtcagtatttattatggagtcatcttcactctaccttttgactataggttgctgctcctctacagatcatcttctctatgtaattctctccttctgggttccaggagctactcccttcctttgtcctctggctcttactagcctccaatcccttatactttcccaacaccatgcccacacctttagaaacagtcctttcattgaacctttcttaaacactcttcactttagtatgccatctgtttcctgcggggcccctgactgatgcatctgctttgtcttgcctcatttgctcctgctgtagatggaacatgtctgcaaacatcgttacagttgaccccatggaaagatggcaaccctagtggaggaattagccttcttcctgcattcgttttttttttttttttgagacaaagtctcgctctgttgcccaggctggagtgcagtggtacgatctcagctcactgcaacctctgcctcctgaattcaagcaattctcctgcctcagcctcccaagtagctgggactacagatgtgcaccaccatactcagctaatttttgtattttcagtagagataaggtttcagcatattggccaggctggtctcgaactcctgatctcaagtgatctccctgtctcagcctctcaaagtgctaggattacaggcgtgagcgactgcacccagccatcttccctgcattcataattgatctcagaaaatgttctgatggagttggttctctatcactgggagaacgaactcttataacctcagacctggatcccatggcatccctttcacccaggagcagtgtatgttataagaagagtgaaggagaaactttgatgcgctgatgaaagtaataactaattattataagcttgcttaaccacaataaccgctattacctagtaaagttggcataaaaagtaaactacaagccagtctcatacatgagtctagatgaacatatcccaaataaaatagtgaatgctattttattgttgtcacggacattatgcattcaaataatgtggaggaaacaatctagagataaaacaacaaagaaaattatgatcaatataacaaaatataggaataaagataaaaatatgccagcaaggaaccgtggaatctggaaagcataaatttagatggtagaagtgatagcagaatgttacccaaccaatgtaaatggattgaaattctctactgaaaggcaaagactatgagattggatgagcaatgtacaactcttggcagtgtataaaagatgcttaaagcacaggttttaaaaataaaagggacaaaagtgtatcatgaaaatacatatataaaaatgaaacatggtcttaataatgatatcaaaagaaataggactcaaaacaaaaagcataaacgggggcagatgtcccagcagatcacttgagctcaggagtttgagaccagcctgggcaacatggcgaaaccaagtctctacaaaaaaaaaaaaaaaaaaaagaaaaaattagccaggcatggtggcatgcacctgtagtcccagctactcaggaggctgatgtgggaggatcacttaagcctgggaggtggaggctgcaatgagctgtgattgcaccactgcactccagcctgggcaacagagtgagattctgtctcaaataaacaaaactaaacaaaaacataaaacagggaaggagaaaacatgaactctaatgcattactggtgagtggcaaattagtatatgttttctaaagagcaaattttccatacatatccagagctttaaacacatttttgacctaagaattactaaatctaatcattttgacctaagaatgacaattctaggaatttttggtaagaaaccatttcaggataaatgcatagatttatctagagtgatattcattgcatcagtatttataatatcaaaaatttgaaaatgacccaagtctcactaccaattagagtttatataagtaaaatatattacagtcatatggtggaatgctggccagtgattcagtgtcacagtgtctggggataaggggaatgttctgtgtcttgactgggatggtgcctatacaggtgtacacatttttcaaaactcatcaaactatatgcttaaactctgtacattactgtatgtaaattatactttaataaaaagtcacagtgattaaaatgccattggcctggaaatgcagtcataatatattgctaaatgaaaaaaaaaaagcagacaacaaaacattaggtcaggtatgatagatttaaaaatataaaaatatatacacatgtaaagccaaaggccacattccctaaataaattttcgtgaatacttaattctgttcactgtcttatgccagacttgttacctgcagagctctgaaggtcactttgggatgttctgtagctggtttctccagttttgtttgtttctggggccactccacctctagtgcagactcaggtttcccacttagttcagtgaggaccaaacttgagtggcggttccggcgtaatcgggagtcacttacagttccttccaaatgtggttactcttgaggtcctccatccgctgggagtcagctcagttcctggactgagcatcttcaggtgcttctaataagattctggcctctgataagtcttgacttcaattcatttttggccccagagaaggggaatcttggctctgccaacaaggccctgtccatttcctgcctcagtgtgagtggcaggaagaccaccttgatcttcagggcaaaggctcgcttcctcctcttggtgtcatccggtctccttggctcagtaaagcaacgtaacagtcaagtgcacttttctcaacgcctggtttcttctgtcttacataaccccaagtggggacacccacagtgaactttcaaaaataatgctccttccagggagcgaagcagcaatgagggttgaacatctctcttgggatgaccatcacctggaccaaaagacccatttacatctctcaaggataagtaatgtcaggggcaatttagtctaaatgatacagtctccacctcccttcctcccttcctcccttcttccctctctcacttatctattatctccctacatctgaaagtgcaccatcctgctgaaatcacatcctgttcacataacactgcagtccatagcttctgaatccacacagaagttctcgtgggcgataccaaatgccaagaggatgccttagaaggagtctggagatactcgaggattggcctctctagctcagaggttacactgtcatcaaatgtccaaagagctcttgtacagaatttttgtggtgcagttctaaaggagaagtaggactgaggtccatctgtgcaggctaacgaagaacagcccatactgaccaactggttgctacataataatattagctccccatccgaggatagtaaagctcaattgccaggcatgctgtagagggcatagctgtggtagatgtgggtttctaccatgttggtggttctactagcttttgttgttttgttgcatgcaacagaaaccatctttggttaacataagttggaaaggaattcattggaaaagatgtggcatccttcagagcgttgaaagaaaacttgaacaaccagaccagttctatctgattttggttcttgtgttacattcagcctaaattcaaattccagaaggagagagattatctggccgagctcaagttgcctaacaaactcttgggtcgggcttttaaaatgttctttcaaagactaaacgctgtgggggtaggatggcttttcaaaggagaatcgaagtactgatacggggagcagggggtggggagggggaagaaggcacagatgttgcgccaattggaacaacgtgtttgctacaatttctaaatgctacattgcagattgcagagagattggatgacaggcttcacctgaagagatagagatcaggacctgggaatccatgtgttaaaaagttcttgggtaattctgatggatagctgggtttagaagccagtgtaaggcaatatgtataaaagctctgaaaccagaatgactgagtttgaattccagtttggccactaactagctgataatcttgggctagttacctaacctccctgcttcagtttcctcatctataaaaagaggataaaatggcacccacctcatagggtccacgtgaggattaaatgagttaacctagatggtaagagcttcatgccgtaactggcacataggacatgctagttaatattattgccacaaatgatcctttcaagtcttagattgtgcatttcaaaagtccatccttatttttggaattgcatgcatttatcttgctttctgcaaaatggaaaggcatctcccatgggctggttggagagaggggctgataaaatgatggtaatgtgataaaatgcagttctcttgattgtcaagtgaattctgcatgattcttctgctctcatttgccacgggctgactgcttctgcaatgcagaacccgcttgtaaaggtcagaatgaattgcttccaaacatccctttgtccctcactgtcacgaagacacagagctgcatgctgtggaggaagaagcaaatccatgatgctggaaggccagagaacagaaaccaaccgtgcacagagaggcgagctgctgggacttgaatgaagctgatgcgtcccatctataaattattgtggcttctcctagttgggaggcaggaccagcctcacaatttcccagaagaccgtaatttctggagcctgcaggcctgggggcaaatggagaaatcaaaaggcagatggccttggagataggcagccagaaaggatgtgaaaggccctggttctggactcaagagacctcacgtttcctagtcttctttctgtctctgctcttttgtgttcatgaggttcatgccctcatgagggctcccccacctccagtggtctaggattctaggatgtcttggtattctttttcaaaaaaaaaaaactaagagccagcatttatagatataattctgtcctaaacactttacatataataattcttcattcttcattacaccctgtgagataggttatcattgttataattccatttcacagatgaggaaactgaggtactcagagactaaatgacttgctcaaggtcacttgtgagaggtccagctctaggccctctggcccgtggggctatgctcttacctagtacctcaaactgcctggtagacctcaaccctgtgtacctgcacaaatggtcctgaagcaggcagctttcttccctgagagctgcctttccagatatgcactgccaaaggtctgtgaccctacagccttggcctgatttggtccagatgcgtgtggacatctctcccaaacaggatcaaattggcctcttctaggagtttagaatttggaatcaagggtgctggttttagtctggactggtcacacagtttttgacaactgtttattgtacgggaaaagtgtccagcttgatgaattctcacacagtgaatttttctttgtaagcagagccccagaagcccttctttgctccttctaatctctacacgtccctccccatccatcaaaataaccactaccagaccagcaatcctttggctgcttttccccccacccccagtgatctattttattttattttggaaagaacacgtaacatgaaatctatcctcttaacaaagttttaagtgtaaaatgcatcattgttgatgatggatgcagtacgagacagcagatctctggggcttattcatcatgcttgactgaaacttgatgcccattggtaagtaattccccattttgcccttcttccaggctgtagccaccaccctttcactctgattttctatcaatttgactatttttgttactttacgtaagtggaatcatctagtatttgttttcctgtgactagtgtttttcatttaccataatgtcctcagggttcatctatgttgtctcattgcagaacttccttctttttggggggctgaaaaatattccatcatatgcataaacacattttccttatccatttgttcgtcagtggacacctagattgcttccacgtttagctgttgtgaagagtgctgcaatgaacatggaactgctaacatttcttcaggatgttaatttcaattcttttgggtaaatacccagaggtgagggtgctgaatcatatggtagttctatttttaatgttttgaggaaccttcacacgggctaaggacttgaataggcagttgtccgaggaagacatacaaatgaccaaaaggcatatgaaaatttaaaaagctaaacatcactaatcactaggcaaatgcaaatcaaaaccacaatgagatattatctcacacttgttaggatgactattttttttttttttttgagatggagtcttgctctgttgcccaggctggagtgcaatggcgtgatcctggctcactgcaacctccacctcccgggttcaagtgattctgctgcctcagcctcccagagtgctgggattacaggtgggagccaccacgcccggcctatttttttttttaaaaaagacaagtgttagcaaagatatggagagattggaacccttgtacactgttggcaggaatacaaaatgttgcagatactatggaaaacagtttgcctgcttttgagcacttaaaaaacaaaactaggctgggcccggtggctcacatctgtaatcccagcactttgggaggccgaggtaggggggatcacttgaggtcaggagtttgagaccagcctgaccaacatggcagaaccccgtccctgctgaaaatacaaaaactagcctggcatgatggtttttgtatctgtaatcccagctactcaggaggctgaggcaggagaatcgcttgaggttgcggtgagccgagatcatgctactgcactccagcctgggtaacagagcaagactccatctcaaacaaaaaccaaaaaacagaattatagagtagaccatctcttgtgtctggctggtttctttcatatgtgtgtgtgtgtggccacatgatattgaaaggacacatagcatcctgttcatcaggatgtccagcttcagagccagcaggggccaggcaggtgggtgaatgagtgacgtgtgtgaccacaggcatgtcccattggcccattgaacaccctatctgaaaggggcagcggcactcagctccgtttcctaattcctgctgtttaaaggatgaaggtctaagttttcccatttttttccagagaaatctgaaatcccctaaatttagattttgacagagaattcaagaattacaactgtggtgtattttaaacacatttttggactggattccttctgtgaacctccggtttacaacttctgcattcgtaggtggggactgtcagtggaaggtctcccccaccccacatcggaggggagaagggaaaatgtaaatttagtcaaatgggctttctttggagagtagagagtgtgcaatagtccaaggcagggagctttaaaagaatgcagaagtcttttttctctcttggtgtctgagctctaaattggctgggacatatccttagttaggagtcagtggctatagcgccccctgctgtcctttagcaccctcttcgtgtccagtgagatctgcaggtgagcctggaagccacttgcttctcctgcaggttttgggaggaagattcatcattttaaatattgctcaagtgcctgctgctgccagtgacttcataggctcctgttagactcaccttcacttatatttggtcaattacctactccctcagtcagaccttgccactcgattttttttttctttttgatacaaggtctcactgtgttgcctacgagtgcaatggtaccatcacggctcactgcagcctctgcttcccaggcttaagtgatcctcctgcctcagtctcccaagtagctggggctacaggcatgtgccgctacgcctggttgattttttaatttttttgtagagatggggtttcatcatgttgcccaggctggtctcaaactcttgggctcaagcaatcctcccaccttggcctcccaaagtgctgggactactcaggcataagccaccatgcccagccaccactctatttttttttaaattggaggtagggtaagaaggactgggccaggtcgtccttcccacaattccagtctcactgtttctatctattgaaaagcatttctggcatttgcttggtacctttccctggtttctgggctgaaatagattttatcccatttttaaacaattccttctgatactttcaggggtagtttgtggatgagagcagagtgaaatgcataggctcaggtttgtggccttgcaagttaataaagagtgtggactttggaactagcctgcctgggctccaatcttggctctggtacctactagctgtgtatcattgttttcattgttttgttttgttttattttgttttgtttgagacaggatctcactctgttgttggggccagagttcagtggtgcaatcatagctcactgcagcctccaattcctgggatcaagtgatcctcccacctcagcctcctgagtggttaggaccacaggcatacaccaccacacctggctaattttaaatttttttgtagagatggggtcttgctatgttgcccggatgggtcttagcctcccaaagtgctgggattacaggcatgaaccattgtgtcccaccttagctgtgcactttaaataagtcacttgacctctctgttcctgtttcttcatttacaaggtgaagatgataatatactacttcttagggtgagtattaaataagttaacctatgcaaagaggttaaaacagtgcctagcatatcatagaaatgtttgcttgacccagaggcctgaacctgctttgccttcagtgttggtctttaggtcctggcttcactccttaatgctgcatctcagcctttcctcatgaaactttctgtctttgatccttttcactccttaactgtgaatctcccaaattccactgagcagtgatcaattcttggggcatcttgctctgtgttcccagacattccttcaccctcattttctctccatggccaaatcctatagtgcctcctaaataattatagctgacatgtatgtagcacctatcatatgccacgtgctgttctaagtgattgatatatgctaactcatttaatcctcaccctatgagaaagatgcttttttaacacctattttatagaggaggaaactgaggcccagagaagtgaactgacttgccaggtcacataactaataagcagagtctggatttgagtttggctctagagcctgctcttagccaccatgtcccatcctcactgagaggacccttgttcaactccactaaccctctctggacaagtagcctctggtcctgtctccctgcttcctctctgtctcactggcctaccctttccacacctttctaaaaaccaaatgtgatcatgtcatcctctttgttgaaaacatgtcaatggcttcccattgttcttgggacaaagtaaatactctttgaagtggctgcgaagcagggtggacatacgtcctcctctgccaagcttgcctataaaccaaattggtttgttctgttgtgtcagcgtaccacaaggctggtgcccttgtcatcctcacaagagtccctgttggaagatacaggatatgattgtcctactcatgaggccctgcgtgctctggcgtcagggtccctccagcctttgcttgaccactctgagtaccttcgttcactcctctgttcatcctgccaccaggcatttgcacatacttctcccttggctgagatactcttctctctcttcttccctgtgagttcagtgggtctcaattctagttgcattgtagaatcttctgcagggctttttaactgaatgcagtgtctgcacccattccagaccaactaagtccaaatctctgattgattcagaacctctcagttgcatgcagggttaagggccctggtcaactcacgctggtcctctagactgcagctcaagcatcacttcctcagggaagcccttcctgacctccctgaccaggcccatttccaatattttgtactcagcacaccacatacctcttcttgctgtcacatatcttagggacatctaaatattaggttggtgcaaaagtaattgcggtttttgctattgtaaataatggtgcaatagtaattagttaaaagtaattaaaaataatggcaaaagcacagttacttctgcaccaacctaatatttacttacatggtgacaaagaacccagattctggataaaaatgaatcactagctgtgtgaccttgggcgagttacttaacttctctgtgtctcagttttctcccctataaaataggaatagtcaaaaacctgttttacatggtcgttgaggatcaaattagttcataatatgtaaggcgcttggaacagtgcctggcacatggtgagtgctgtatgtggtagctgttactgcactagtaattattaccccctgctgggatctgtaaatccctgaaggtggggttggcatccgttgtttgatcactccacacctaggatgctgcatgaacataatagctcttcaatacctgtctgttcagcagagtggcgtcctagtgaggttcttggtaaaagatgaaaggtgagatgtggaattgcaaaaaaaaaaaaaaagtatagacatcagagttggcctgcacagaattcaccttcctcagttagggcccttgtctatgcgggcctgctggttcagggtcattgtttctagcggtcatgaggatcagagcctgcctggacttgctgtgtgcagagtccccggtgcagatggccacctggcaggcatttgctccagcagcatcctttgcaggaatgggaggctcctctgtaattcacaaactcaccgtgtccttctatacagaggatctttctgctcttctgaaatgcagacttgggtgtgctgagagcttctgtgacagagggtgctgtcaggaagctgggcatccagggctgcacctggaaaccaagctggcagcggctttgcaagttgaataatcttatgttgtgatcttgcatttacgggaccccccacttagcaaaaaggggtgctcagaccacttcccttagttggcttacggcactgcagggggagaggggtggggaggggaggagatgggtgtggttttgtgggtgatggaggatttatttataatgtgggtgtgatccgttgccatgtgactattccctgaaactactgtacaccctgagcaatgaatgcacaacccggcctgcacaggaagaggtggggctcactctgtgaacagcctccaccagaactcgaaggccccctggggaataccaagcctaacccctttgttttcagaaggaggaactgagaccagaccatggcagtgacttgcccaagatcacagatgtcatttttattctaagctaacatttgtcatatggatactacatgccagtcactgtgccaagctaagcatcatcattgtgatttcattaatctgtacacatctagaaagcaggctcattatattcagcaaacacttgcatagtgtatatatgatgtgccaggcactgtgctgagtcttttacaaatattaatccattaaattctcataatcctatgaggatttagtgtgattattatttccttttatttatttatttaagacagagtcttgctcttgtcacccaggctggagtgcaatggcatgatctcggctcactgcaacctccacctcctgggttcgagcaattctcctgcctcaacttcctcccaagtagctgggactacaggcacccgccaccatgcccagctagctaatttttgtatttttagaagagatggggttttaccatgttggccaggctggtctcgaactcctggcctcaagtgatccgcccgccttggcctcccaaaatgctgggattacaggtgtgaactgccgcgcctggccttatttccattttaaagatgaggaccctgaagctcagagaggttgggtaacctgtccaaagtcacacagctgggaggtcattgagttgggagtcaatctcagacagtctggccttgaagtgtctgctccagcactgtcatttctctccatgtgacagctcttctctccattttacaggtgagaaaatcaaggcttatataactcaagtagcttgctcgaggctgcacgactggaaattaccagagctggtgttgaatttgcacattccagctatagaatctgacccctgatctcatgctaaactccctctcagtggggctagggtcttttggctgaggggtccaagctgggaacaggtcacgggggttgaggcagagcctgaagccagcaggtggaggtggggtggtgtcagccaggtctacctgggttgactctgaacctcatgcagtggagcagttactcccttcccatggggcagagccccagctaggtggccatcgcctggttacaccctctaattccttaagatttcagcttaaacttcattttctcagggaagccctcctgactctatccagccgacactctccttgtaaattctctaagcactgagtgtctcctttgcagctgttggaagtgtacattggtttatgcttctttattgttttccccaactagactgacatagggaaggtactcaacgaatatttggtgactaaatggttaaataagtgaatggcttatagctgtagtagaaggaattggcacaggaaatcaagactgaagtccaagaagtggaaatatatataaggtttattgggaaaagtcacaactcagtaggcacagggatgccctgagcagtgataattaataattaatagttaataataatagcttgtacttattgagtgcctgctctgtgtcaggcagctgttttaaaggttgtgggtaattcattccctagaacctcacaaaacaaatattgttatcccctagggataactaccgctagggttattatcctagctccccctagggttgttgttcctagacagttaaggttaactagggataacatcaagagagctggcccaaggtcaccatttcttcccagcttttaaccaacgttttgagaatacagtattccccatcaaaatcgtggctcaccacggctgtgagtttcacccagcggcctgggtggtcatggtgaaagctagaaatacatctctggaagacattttcaggtatgctacagaggctggcatacccgggctaagagctgctggcctggctaatgaactaagatcactcgttgaaacaacaggtataaatctccaagcagaaaagactcgcttaacatggatggcaaatgttgtctaccaagaagacccaagaaaataatcaaataccctttgccaagaatgtctggttataaaataaagatataaatgacaataacttttctgtattttagcaacaaccagttaaaataaatttgaaaaaatcccagttaaaatagcaataaagaggtaaaatacctaggaataaatacttaggccccaactaagagagtttatgggggaaaaaatcttttctggaaaaacacaagaaggctcaaattacatgtgaattccacccctagctcccccaatctgtttttctcctggcagccgtggttctatatcacatcccacctcaccccttagctcagccacagcacccagctctgcacaattccttattctaaattctgattggcccagttcttccttcataaatttcatatcactgacccaaccttggtctattcagcattggctggaagtatgaggtcagatgctttactgtccactgagctggtgctgtaggttggaatttttctagaagggtcaataagttaagcagccaatgattggcatttccagcacaatctgggagaatacatggataagaataaccaagaaaaatttgaaagtaagcaggaatgctaggggaggggccagtgggtataaaggtgtgtgcctctagataccaagagcttatactatggtatggtgcaacggtggggagagagagacagatcagtggagcataagacaatattaaaaaatgagccgagaatacataagaaattcgtgtatcataaaagaggcatttcaaatcagcagggaaaagatgcatttcatacatttgctgtctaaacattaagagtagaaataaaggtctttcttgagagctcatgctaaaatgaatgccaagggaaatgatgatttcaatgtaaaaaagtgaaaccataaaagactaccagaaaatatcaggaaggactttctaaatacgacagcagagacagaaaccatacaggaaaagggaaaaatttgcactttattaaacacgcaggcacacacacacacacacacagacacgcacatgcgttatacgttgaaaaaagaacatcgacaaaattaaaaggcaaatgagaaactgggaaaacatttactgcatatatcataggtgaagggttaatatccttaaataatacacaggaaaatttgttacaaataatttgaaagaaacaaacttgaattttaaaacaggcaaaattaatgataacagtgaacatttcttctttttttgtttgtttgttttggaagcaggatcttgctctgtcacccaggctagagtgcagtggtgtgatcctggttcgctgtagccttgaactcccggcctcaagtgatcctcccacttcatccccacaagtagctgggactataggcatgcgccaccataactaatttttttttttttttttttttttttagacagagtctcgctctgtggcccaggctggagtgcagcggtgcaatctcagctcactgcaagctccacctcctgggttcatgccatactcctgcctcagcctcccgagtagctgggactacaggtgcccgccaccacgcccagctaattttttgtattttttagtagagacggggtttcaccatgttggccaggatggtctcgatctcctgacctcgtgatccgcccacctcggcctcccaaagtgctgggattacaggtgtgagccactgcgcccggcccataactggctaatttttaaatgttttgtagagatagagacaagatattactatgttgtccaggctggtctcaaactcctgggctcaagcagtcctcccaccatggcctcccaaagtgctgggaatacaggcgtgagccaccggacctggcagaacatttcttaaatgttcatcttcaccagcaactttatgcagtttccatgcagtatctcactgaactcttactaacctaggaattaagcattattattattccagtttccacacaaggaaacgaaaacttaaaagggttaaataactttccctagagtcagaaagttaataactggaagagccaagagttaagcttagatgtggctactaattcacccctatattgacatggactgcagtgcagatcttaacccaggaaatggtattttaaattctgccaaagtttatacaatagaagcttatccttcaaatggaataattacgtattcgccaaatgggcggggttagaagagggcagggtatatcaggcggttgaagcaaatcgtcacccaacacacaagtgtttacatggtgttattggctctattcattctcctctccaggaacaaaatgaaagatcgtcaccaaattatagtgtccccttttcaaatgtgccatgcgtgtgtaattacagcttctaacattctccacttttcatgctcagacaatctccgtccactcagtctcaattaaggtttccctactttttttgtcttttgcaaatttttggccttttgtttgcagttgtgggcatggcagtactgatgtgttactcacggtggtagtacaagaggtgagatttttgtaatacccagataaaccctaaaatattctactttacatcaaaagtatagaaaagtctgtgctgagaagttttactctctgtctactttattctctcttgcctccatagatgaacacttgtattaggttttttttttctttttttttttttggtgtatcctgccagaggtgtaattaagagtcgactttccccggttactcaggaggctcaggcaggaggatcacttgagcccagaagtttgaggctccagtgaactatgatctcgccactgtgctccagcctgggcaacatagtgagaccttgtctctgaaaataattttaaaaagaaaggatacacacttaacttattgcacctcgctttctcacacacacaaaaggtaccatgtaatatacacacctcagcaccttgatttttttgtttgtttcacttaaaaaatacaaccttggtcgggtgcagtggctcacgcctgtaatcctagcattctgggaggccgaagcaggcggaccacttgagcttgagctcaggcgaccagcctgactaatatggcgaaaccctgtctctgcaaaaaatataaaaagtagctaggcatggtagcgtgcaccagtagtcccagacacttcgggggctgaggcaggaggattgtttgaacctgggaggttgaggctgcagtgagccgagattgcactgctgcactccagcctgggtgacaaagtgaggccttgcctaaaaaaaaaaaagaaaaaaaaatgagatttttttccatattaatgcagagaacttcctcattgtactttatacctgagtagtcttccattatgtggctacactatgatttatttaaacaaccctttcccagtgacacttagcgtgtttaaatcttatgctaccctaaacagggcttcagtgaataactgtatctgtatattacttcctatgtatgcaggttattttaccttcgtccaacgtgatggagtgaaaggtgaaaagaatttgtaattttacaaaagcatttgtactttggataggtagtgccaaattgcccccacaggatgacaccaattggcccacccaccaggaatatgtgtctctgtttctccacagcttttcaacagaaactgtcgggatgaacatttaaaattttcattttaaaattttaaattgtctacttcattttaaggtgcattagaaaaggcagtttgcatattgatcccatgagttcacactcttagtttcatttttaaaaataggtttatttaaataaaaatggcagtactgaattgaagaaaaatatcaagtaaatattatgttggtgcaaaagtaattgcggtttttgccattactttcaatggtaaaatccacaatgacttttgcacctacctaatactgttacaggttgaatgcaggcatgcgaagttatgacagctcatgactgaagctggggaaatgttgccatgatgattttttctcttgggaataataaaatcaagaggttttatgttctgtgtgcaggacactgtgcttgaggttttataaagtggatacggttattggacccattttatggctgaggaaccagagactcagggtggttaagtcacttccctgaggtcacacagctaactctggagcctgcgcttgttaatttccctctgttctgagggtatttccaactgggaccttcaatttaaccttgcctacctaccccatgggaagtagagcctcaggagctttcatagcttgtaaatgtccagggatgacacagtctgaacttgcaatttgcttttcctttctcctctatggatgctgttagcttgtgttttctctctgtgtgcctcatttcagcttccttattcctgcagttttacttcagcccaaccagatttcagcccacctgtgggcaaagctgcacagcccattcagactgagagagacttttctttttctttctttctttctttctttctttctttctttctttctttctttctttctttctttctttctctttctttctttctttccctccctccctcccttctttctttctttctttttttctttctttctttccttctctctctttctttctttccttccttccttccttctttcttttcctccctccctctctccctcccttcccttccttcctctttctttctttctttctttctttctttctttctttctttctttccttccttccttccttcttcctttcttcctttctttttctttcttttctccctctccctcccttccttccttccttccttccttccttccttccttccttccttccttccttccttccttcctccttccctccctccctcccccctcctccatctctctcacctgtgcttcctttcctcttagctgcctgtgtctgggattaagtgatgacctaggatctgcctgtctttgatgctggggattgtttttcactataaagactctggtttgggggtggcagggacccaagtactctgtcactggccggtgctgaatttgtgtgagatgaagagtgttattgtctataacccccgtgttaggtgggagactctctggggaggctgaggagcaggggggcagccaggggacactgaggggttcccactcggctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgttcaattcaataaaattggtggcagtaaaagtcacattcgacggttattttgttgttgtattcaacaatctcttgaataaagattggaaatggaaggaaatttgggaatccaagcttgcctaataccaggcatgtggagatggagcctcagcaacaggaaatactgggaagaggaatcgtgccaggatcctgtggaaacctgatttccaggggtgggcgagatgactggggatgatcaaggggtgatgctgcggcaggagtgtaatagtttcaaacctgtttttgagagcacttgagactgagtcagacaaactcactcgggagtttaggggatgtgttcacatggggttggattccagcactgttgggaagaaggtagggagtctggcagaggtcccaaatccaaattcctacagggtccaggcaggaaaggggaaagagagaagcaggcctggtgtaagacaatagggaagagtggggactgtggaaaactagaaagtttattacttatctaaaggggaaaaccactgctcagcccacagaaatgagtgttctgtgttgtcacagctgatgatttctcaaaaggaagcaatatttcacattttttattctttctttctttcttttttttgtttgagacagagtctcgctctgttgcccaggctggagtgcagtggtgcgatctcagctcactgcaagctccgcctcccgggttcatgccattatcctgcctcagcctcctgagtagctgggactagaggtgcatgccgccacgcccggctaattctttttgtatttttagtagagacagggtttcaccgtgttagccaggatggtctcgatctcctgacctcgtgatccgcctgcctcggactcccaaagtgctgggattacaggcgtgagccactgtgcctggccaaaatttcacattttaatctgatagttcctgacttaaatatagtaaacttatttggatttctaagaagcaccttgttggccaacggtagcttctttacaggcttgatatagcttctgggttccacactgtggcccctgggcatgaaggagggcccaggccagggatgggacaggctctaggtggcctggaggtgtctagtcagtgtggcctgggtgacgaggatctgatgtaaaatgagactaggggagggattgaggcagagatggaagctgtgtctttttttttgtttttgagtcagagtttctctctgtcactggagtgcagtggtgccatcatggctcactgcagccttgaattcctgggctcaagcgatcttcccaccttggctgggattacaggcatgagccactgctcccagccaggaagctgcatctttgaatgcgatcagaaccaaaccccatagagggagtgatggcttacaggccatgaggattcccagactcatctcaggcttggtcaatacccacagcatcaaggctaggaagggaatgtattttggttaaaggcaggactgatacttatttatttattttgagacggagtctcgctctgtcacccaggctggagtgcagtggcgggatctcggctcactgcaagctctgcctcccaggttcacaccattctcctgcctcagcctcctgaatagctgggactacaggcgcccgccaccacgcccggctaattttttgtatttttagtagagacggggtttcaccgtgttagccaggatggtcttgatctcctgacctcgtgatccgccagcctcggcctcccaaagtgctgggattacagacgtgagccaccgcacccggccaggcaggactgatatttaacctgcatgccctggcactactgtaccagtggtggaaatattgaaatactctgaaaccgatgggtaaatagccactgggtcctctgggccttttcccccaaccttccacttacccatatctgcctctgccagctcctaccacaccccctccatgacgtggtgactagagtgctaactcccagcacagccaggctctgctgtccattccgtttggtctgtgggcagtccctgagccaaggcaattatagatatcttgactcacccctggttgtaggtaacatgcctacctggattggctgaagcacaaaggacaaattttagaggacacagggaggcagatggaattggaaggcaggatgccagaaccccagggaccagaaccaggagcttcatccctggggtcatgtagtctttgtctttgtttctccaggttcctcagagcgcaccataaaaatcagcaccaactgtcatttgctacaatgtggatgaacctggaggacattatgctaagtgaaataagccaggcacagaaagacaaatactgcatgatctcacttagatgtggaatctaatgaagttgaactcacagaagtagagagtagaatgatggttaccagaagctgggggacagcaggaggcaggagtagggaagaaatggagagttgctgagcaaagagtacaatgtttcggataggaggaattgcctttgagatctattgcacagcagggtgacattagtcaataatatgtatgtttcaaagtaattaagagagtaaatttcaaatatctcaagctaagaaaatgataggcaagttaggtgatggatatgttaattttcttgatttaatcatgccacattgtgtgtgtatattcagaacaatcagaacaatcacattgtaccccataaatgcatacaattataatttgtcaatcaaatataaaattagcagcctcagccctggaactgtatgtctgctggcctcaggactgattacctgtgtcccagccactcagcatatgtgacccttgagccaagtgtccacctctgccccagtcagctgtgttcagggaatgtggatgtctcaaagtacaagcatggcttttgggaggtgcccatctcagagatggcattgggctcaggcaggcatggaaaggtaccctgaaagatgcaccttgagggtcgtggagggagtcatgaggaccacaggtgtaggagtgtggctttaagctctttcaggtagcaggaaggaggagggaagaatccactgaggatgacctggtttgtctggtctgaaggattggggcagtgggtgggtagagttggtgcctacaagtatgatccctcatgaaagcggagggaggggaatgaggtcagaggagctctccagcagcctctaaataagccgtaagaagtcaatgtttccctgcaacttgccgattggttttcctgtctctcatctggctctaatctgtgctgcacagccccttctaagtcattttcctaaaatagcatgtttatggtgcaggggtttgcagtggccaacagcgatgattgcagccctacagctgtcacaacaacccattgaccactgtgtgcaatgctgtgcttgccacgggcaaaacacttcgtctcttagttcttcggtttcctcatctgtaaaacaggggtagtaagtagtatgtactttatagggctgttatgaggatcgaatgcattaatgcctgatgaatcccttaaaatagtccctggcatgaataaatgttccataaatgttaactctcacttattaagtatttattgagcatcttctgtatgccaagtacagtttatgccctgagagtataatgatgagcaaaatttcctcacattgcatgcagtgaagtgtggaagagatgcaattaagcgtgcatttataagtcagtggtttaagtgccgtgatggagaggatttagaatataagttccatgaaagcagaagctcttttgttcacagctgtatccccaatgcctaggaagaacttgaccctcagtatacatttgctaggtgaatgaacgaatgagtcaagttctatcttagccgcacatgaagatgaggtgtcaatggagtaaagttgggagtgaggagagaagggaggggaacttggtgtgaaccccatctctgcaagggtccagctgggtggccttggtgaagttactctgtagttaggatctgtttcattgttgctaaaatgggaacaaatgataccttctgcatggcatgtcataaggattggagagagtacatgtgagacacccagcgtacacatgtagctctcaagcagtgtgttgagactgggtgtggtggttcacacctgtaatcctagtactttgcaaggctgaggcaggcagatcacttgagcccaggagtttgagaccagcctgggcaacatagcaaaaaccctgtctctacaaaaaataaaaattagccaggcatatggcatgtgccttcagtcccagctgctcaggaggctgaggtggaagggtcgcttgaacctgggaggcagaggctgcggtgagctatgatcgcaccactgcactccagcctgcatgacagagcaagaccctgtctcaacaagacaaaaaacaaaacacacacaaacacagaaatgtgtttccttttcccttcccattctttgtgcttcttggtatctcctcttgtttaagagactgttgatatggagaaaggtctggatcatttttggtcagaaatgcttgaatccttgtcttggagatcgctcaagaaaatatttacatgaagaaaagtgcaaaaccaacagaggcaacttattattagttgtgattttgccccagatcttaaagtagagctcacaaggccttgaggaactcctttcttctctactaggcaggactaaggaaattcaaacctgaactcaaacctaactcttggcctctgtaagatcaatatatcagagaaaccagaagggaccacaagagccaagagtagagacagaatgtgtcctaggtcttggagaggagctggctcaggccacttctaccaagggtctcagggcaatactataagacttggacccagtagcgtcctgggagaagtgaaggatgtaagggagaaggagaagagaaagatggcaaggatgccttttaacctccatgcgagctccaccactggggtctggccaatccgtgtcttggaatccatccaattaaatcaactctgcctccttagaggttaagtaggggtgtaagagaacctggagcttctcctacaggccaataccagtcatgaacaggggttccttttttattattattatactttaagttctggggtacacgtgcagaatgtgcagttttgtttcataggtatacacctgccatggtggtttgctggacccatcaacttgtcatctacattaggtatttctcctaatgcctcccctagtcccccaccccccgacaggtccaggtgtattatgttcccctccctgtgtcgatgtgttctcatcgttcaactcccacttatgagtgagaacatgcggtgtttgattttcgaacaggtgttcctttttaggtgggtttgaagcactgaactcccaactttaaggtgaatgtccaagaagcacaatgggaactgttctgtggcacagagcagggggactctgataggaaccttatgtattcacttagtctcattgtccggagatagagacatggctggttaagctgccaaaagggatcccttagttttttggggggtggatttccaagccctgttgttgttactaggacggcacctcaatctttgagcaggacagatgattgctggggtccttttgtagctgagagcactcagggtcccactggcgacagcagaaaagacctcgcttctcaaacttggctgtccagtgctctggacgagtacttcatctgcctgactgcagagggtgggaacgttgtgaaagaaactttgtagctcattaacaagataagaagcaaccgaagtctgcagtggctgaggattttcagtcaggtttattgagacatacgtttcctgtggtaaaagtcactttaaacaattttttttgagacagggtcttgctctcccacccatgctggagtccagtggcgtgatcatagctcactgcagccttgaactcttgggttcaagtgatcctcccaccttggcctccctagtagctagaactacaggcatgcaccactatgtctggctttaatacatatatatagtagagacagggtctcactgtgttgcctaggctgatctcaaactcctgggttcaagctcaagcagtcctcccgccttggcctcctaaagtgttgggattgaaggcatgagctactgtgcccagcaaaattcactttttttcttttttcttttttttgagatggagtcttgctctgtcgcccaggctggagtgcagtggcatgatttcagctcactgcaacctctgcctcttgggttcaagcaattcttctgtctcagcctcccaagtagctgggactacaggtgcatgccactatgcccagctaatttttgtattttaaatagagacagggtttcaccatatcggtcaggctggtcttgaactcctgacctaaggtgatccacccacctcggcttcccgaagtgctgggattacaggcatgagccactgctccaggccacaaattcacttttaaaaatataaagtaaaattcatcacagttaatatatagaccactccaatatccaaaacaaaaaagttgctgcatctgcctctttttagttaattccctatccacctccaaccccttttaaccactgatgttttctgtccccatagttttgtgtttttcagaacatttagaaatgaacctacacttgtgttgaacatctttgttttaccagaatcctttcgaggttcatgaatgctgctgcatgtgtcaatagttcattcctttttactgctgaaaagtattccactgtgtggatgcctcacactgtatccattcacacgtcgaacgacatttgggtcctttccagtttggggctattataagtaaggtagctataaaccttcatgtatggatatggttgttgttttttttttttccccttctctgtcacccaggctggagtgcagtagcacgatctcggctcactgcaacctccgcctcctgggttcaagtgattctcgtgcctcaccctcccaagtagctgggactacaggcatgtgccaccacaccctgctaatttttgtatttttaatagagacagggttcctccatgttggccaggctggtctcgaactcctgacctcaagcgatctgcccgcctcggcctcccaaagtgctggaattacaggcgtgagccactgtgcccggcctggatgttttcatttcaccgaaaagtaggattcctgggtcctaggagagttccagtttatgttctttcttcactaacacttggtatcgttggttttagttttcaaacattttagcaactctggtaggtatgtgatatggttaggctttgtgtccccacctaaatctcatcttgaattgtaatcctcataatccacacatgtcaagggagagaccaggtggaggcaattgaatcttggggcagtttcccccatgctgttctcatgatagcgagtgagttctcacacgatctgatggttttataaggggcatgtccccctttgctcggcacttctccttcctgctgctttgtgaagaaggtgccttgctttcccttcgccttccactacgattttaagtttcttgaggcctcctcgtcctcaagaaaattgactgttagtcaattaaatctctttcctttgtaaattacccaatctcaggcagttctttatagcagtatgaaagcagactaatacagtatggaattattttaaagttttgaaaagaacagtttccttaggagaagcactcatcacattaacagcacataaaagaatatctatgtagtatgtctgtttatttgcttacatgttcattttctgtcactagagtacaattttaaaggaggcatctgtggcagcatcaataaatacatgtgaatggatgaatgaaggaaggaagaaactggtagcatgtaccaaaggctagggtgtcagatcagccctggattggaacctaaggcccatgttattaacttctgccatgtacttttttttcctttttttaagagagagagggtcttgctctcttgcccaggctggagtgcagtgatgcaatcatagctcacacatagccttgaattcttgggctcaagtgatcttcccacttcaacttcccaagtagctgggactacaggcatatgccaccacacctggctaattttttattgttgtagacatggggtctcactatgttgcccaggctggtcttgatctcctggcctcaagtgatcctcccaccttggcctctcaaagtgctggggttataggcgtgagacactgtacctggtctgcaatgtataacagagaaagcaacttttacagaaagagttctcttgaactaaaaccaattctgtgaggaaagaatctcttgaagaagaaagagaaatgcagagccaaaggcttacaaagggcatggtctgtttgggagcgggggtgcgctctgagtgctgagaatgtacatagtatgtgtgcatgtgggtgggtgggaggagggggcttagctggggatcaccttggccaaatagtaatagcaatcatggaaagcttatgctgcttgctatgtgccaggtggttctaagacctctacacaggttcattcatttatgcttcccaacagtcttataaggagagcactagcattatcagcattttacagatagggaaactgaagcacaaaaagatcaaattagctgggcatggtggtgtgcacctggcattccagcaattttggaggctgaggtgggaggatcatttgaggccaggaatttgagactagcctgggcaacatagtgagacccccctctctacaaaaaaaaaaaaaaaattaaaaattagctgggcaggttgggcacagtggctcatgcctgtagtcccagctactcgggaggctgagacagaagaatcacttgaacccaggagacagaggttgcagtgagccaagattgtgccactgcactccagcctgggtgataagagcaaaactctatctcaaaaaaaaaaaaaagatcagctcagcatagttgcatgcacctgtagtcccagctactcaagaagctgaggcaggagaatcacttgagcccaggaagtcaaggtcccagtgagctataattgtgccactgcactccagcctgggtgacagagcaaaaccatgtctcttaaaaaacaaaagaaaacaaaaaaccatcaaacaacttgcacaaactcacacagcttagagccccggaagtttatccaagtctgccttttaccactgcactgcactgccaggctatcaagggcatatttattgattaggaaattatgtaaggttctgtgagaaatagctcccaaaatatagtgacttaaacaaggcagaaattaggtttttctctcaggggtcagcccaaagggacaaaattcaaggctggtagggtggctttgtcctttccacatatggctccaagtttgggtccaggacagtcacttccagttctcaccatctttgaaccagtggggagagggaaaggctcaaggaagtatgcatttccatttgaagggaatggccctggagcacacacatcccattggccagaactcagcaccatggcggcacctgcaagaggtgctgggaaatatggcctctatctggatagccatgctctctgctaaaactcaaggattctactattaaagggaagaatggatattggtggaaaaccagcagtctctgccacaacttgcagactgtccactgggctttgaactttattctgtcagtgatgaggaactggcaatggtttctaagcagggagatttcacatccagacttgggtttttgatcactgcagaagcatgcttggagaataaaggtggggagaaagaaaagtcaggagccctgtttagatgatgtgtctgttactttgttttcccatctctggagtccctactacaggcaggagcctgtaggttgagttcccaggcaggcccagatggagggtttgcaggcagggtgagtgagcatggggctgcaaagggaacaatcatctgtctttgtccttcattccttccacaactatttatccagcaccgtttctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacagtaagtactttttctctctgggggcatctgctgatggcagaagcaatgggaagggctgcttccacttggtttggggtccaggtctgccatacattcccccctgtcctcgttggggctggtgtaccagttatctgttgctgcataatgatcctcccaccccaaaacactgtgactgaagacaataaacatttttttagctcatgactctgcaaggcagttctttgaatctgggctggcctcagctgatgtcacgcatgttcataaagcatgaactcatggttcatggtggattagcagatggaggtgggctgggagctgtctgggccatggtggcctcacccacatgtcctggaggatggctggctgtcatctgggtgatggtgatgaccaggccacgtgtctttcctcctcagtgggctaggctacctagcctccgtgcatgcacggaggtcacagggtcctgagtttcttaggagggcaagtcccattggcagccacacttcaagtctctacttgtgtcttttgctcctgatccactggtcaaagcaagtggcatgtgagatgcacagtcacagtgtgggaaggggcagtccatggctgttgacacccagaggcatgaacaaatcatgggcatttctgcagccatgcaccaccactgttttcagcattgagatgtggggctgatgcattctttgcatggagaagacctgtggccctgcagcacccacaggtttgtgctggaggaggaaagagcatcattctctggccaggatgtggtaggaaaggcaggtggggtaggactcctctttatgaggccaaggcccggatggcctgtggggcaggggagcagacaggctttgagagctatggccacaaagctacagggacactggaggtgctggtggctcccacagacctgttggtctgcagcaggctgggtgtcatgaggctagtggtactgctctcccaagggtcctgaggcccagaggacagagggagaaagtcatagggcagagagtgacagagaggactgtgagggtgaataagggtggtagggagcaagacagacagcaagaaacacacatgcatagacagacacagatgcaggggaaagatggacacatgcaaccctaacacagggaggaatgtggggcgtggaagctacagagagactcagctagagagagactcaggcaaaaggagggacaggcagacacacagaccaacagataagccaggtgcagtggttcactcctgtaatcccaacactttgggaggctgaggcgggtggatcacctaaggtcaggagtttgagaccagcttggccaacgtggcaaaacccaatctctactaaaaatacaaaaattagccagtcaaggtggtgggtacttgtaatcccagctacttgggaggctgaggcaggaaaatcacttgaacccaggaagcagaggttgcagtgagctgagatcacactactgcactccagcctgggtgacagagtgagactctcaaagaagaagaagaagaaaagataaaatgattggcatggacacagagagagacgccattacacaggctcatgcagaggtatagagatggaaagaccagagacagagacagaagcacacatggagagccacagagagacacggaggagagaggcagagagacacagttggagaaagggagagacaaagaggccagagacaagtgcagagagtggaacagaccgattcacagacacggccaaggcagtgagccacgtgcagaagtgggacagcagagacaagagacatgcagcaacgtggaaacagagagacagacacagaaacatggcaagagccacagggggacagtgaggttggagccttctgcctgcaggacaccagctcctcttaccacacatggggccctaatatagggacaatgtccctgcctcagagacagtggtgggtgggagctcaggctggtgctcaggtcccagagggctctcccttccctccccacaactcatttctagtttttgtaataggcctgctgcctcctgggacttgggtggtctgagaagggtcccttgcccccagatcccttgaaataggggcccatggggtgacttggcctctccttctggcttctccaactggaactagcgtccccctggagaatcctgggtgcctggcacaccttcctggagtggggcattattgctcaagacctagaagaaatcacccaccacattgaaatagacacagatactctacggaggagtgcgcagagggagtggatatcctataacatgagagatggccgaaggccaaattcagtgtataggcacattttatccaccctgccctggctctaaatctttttccttgtaattaattatggtggacactatggccagcccagaccccctcttcatggtcccaccccatcccctagctgtggttcacagcagtgccccatcctgcataattgcccaagataatgcctcttccagggagaccagatgattgtggtgcccagccctcttgtctcagtttggaacaactctgaagggtcatctcagctctgggctccccctaacatcagctttgattgcatccacgtggcaaacgaacttctccccacaagagcactccccaaaaaccttgtgctcaaaactccccgtctcagactctttccagggagcccaacctattagctgttaatatttaaaaatcagagctgtcacgtacacatcgagattcctgcatacgttgagaaatggggaatgtttttgctctgtttcccacttggcttggccaagtccctgccacccccttagctttcctcactcatgtgaccagccagcctgtgagcattgaagttggtgactctggcttcagagccttaaggggtgtggggtgtgcttgcttcagactgcacccttggctgtgggtggggaacagacaagttctacctcctttgcccatcagggttcagggggaagagttggaaaagcccttctgatgagatcctggcaggcaagttggtctcagccaggctcgtgtgtctcagctgtctcaaaggagggaaacaggaagggctcagcggtcttgggtggggcagatgtctgcagcccccagcctgggccagcctaagccacatcccctctctctgccctcacagcctgcatgatgaatgtgcacaagcgctgcgtgatgaatgttcccagcctgtgtggcacggaccacacggagcgccgcggccgcatctacatccaggcccacatcgacagggacgtcctcattgtcctcggtaggtggccctggggctccactggctcctgaccttgcttgacctgtgtgattgagaaggggagggtggcggaggggtggggcagtccagtggaggggtggggcagtccagggacggggagggggtgtggcactgcttctgccccatgccctgcccatgacagcccctccctgcagcagggggatctttagaaactgtacaccctcaaagcttcgtccatcagcaccccaggctgacttgggttcagagaggagacgtctgagttccttggacttctaacttcctcaggatcctccacttcccttctctccttctcatttcccactcttttttagtaatcttttgggatgggtagttgcatttcctttactcagatagcagagaagggaagcttgcttcttccgcaaacttttccagcaggaaaaatggagtcttgatgataaaccccagatttggagaatataatatcttgggaaggaggagggttggagggtgcaattcaggggctttccacatatttgaaatatttctttcttgaacctgatggtggctatgctgtaattttattattctctatattttctgcatgtctaaaatatttcatgataattagaaagcaggatggtacagtctcctgggagatgcagtgagaggaggagctgctggtggtggtggtggtggtggtggtggggctgtcactcatgtatcccagcattcaagacatacctggctctgatatgggaagttcaagcaaaattggaactcagcagcactggcttgaggaatactcagccataagccccggtataaccagcactgagctggctgggagtggagctaaaactttgcaggaatttcttctcaaaggctagtgacaaactactgtggactttatatatctaatgaatataaataagggtttatgagttggtaactcaggaaattgatcatggaagagattaattttgcaaaaattagtgtttctgaggcctcagactggttcagtagctctgatgcattgagccctgggttgcggaggggctttacgtagattgtgtaaaagctgaaaaatacttatccctgtacaatataattcttttaaacttgagatttcgtgaagcccagtgagattttagaaaatgtgcaatccattgcattatgttttcctccaagtggtcgcctgcctcccagtgtgatgcttgggggccccaggggaaatcccgcagtttcaggttcaagggaagccagttttccccactgattgaggttcccgatgctggtgagacaaatatgagactctgcttccctctggtgtcattctgtgggaaatacactcgttccaaagcatgactgcgggcagccaacatttatgggccgcatgggatgtgcagtgctctaaaccttacgtgttatctctttccaccttcacaacattgtgaaatctctattattcttgtttgagagggagactccatctgttgcccaggctggagtgtggtggcgccatcttagctcactggaacctccacctcccgggttcaagcgattctcctgcctcagcctcctgagtagctgggattacaggcgcccaccaccacgcctggctaatatttgtatttttagtagagacagggtttcaccacgttggccaggctggtctagaactcctgacctcaagtgatccgcccatctcggcctcccaaagtgctgggattacaggtgtgagccactgcgcccaaccttctattattcttgttttatgaacaaagaagccacggctcagagaagttatattccaagagctcacaccatttgcaataataataaaacaatagctaagatgtgtttagtttttaaaatgtgttaatcattgtgaaaagcacttacaggcagtatctgatttacattgtttcaacaactcaaatgagttaagttatcattctacccatcagaaaacacatttcctcacctaggtctgtttgactcaaaagtactatatagtaggttacttttttgtttagtttagtttcgtttcgtttctctatgccctccaccgtatttattccttttgtggtttggctagggcacctcctatgggcattccttagggagtctttgttctgatgtggtacagtacaatatttcttcaagttcaaggtcaaagtcttcccccttaatcatagatatgctgtgaactttgagaacctggatcacaagcccccgcttctcaggacacactgataggaggtgtatccatttgctgtggctgccataacaaaataccacaaactgggtggcttaagacaagacgtttaaaaaaaaaaaaaaagaaacgaaaagaaaaagaaaaaaacaataggccaggcacagtggctcatgcctataatcccagcgctttggaagaccgaggtgggtggatcacttgaactcaggagtcagcctgggcaacatgtcgaaacatcatctctactaaaaatacaaaaaattagccaagtgtggtggtgcacgactgtaatcccagctacttgggaggctgaggcaggaggatcacttgagcctgggaggtggaggttgcagtgagctgagattgcaccactgcactccagcctgggtgacagagcaagactccgtctcataaaacaaaaacaagaaaaacaaacaaacaaaaaaggccaggtgtggtggctcacacctgtaatcccagcactttgggaggctaagacaggaggattgcttgagactaggcgttcaagaccagcctggccaacatagtgagaccctggcatattgtaggatttcatttctttgggatgttcagagcaggcaaatgtataaagaagtttaatagcactttgtgcttttccaaatactttgatatcacaccattcgggaaagggcacgttgttgccatcatggaagggaaaacgaagtctcagcaaggctgaacaccctgaccaatgtcacatgctgagcaggggtgagcacctgggcctctggccccatgtcacaatgccctgcaattgcccatacaccatgctgggcacagcctgtactcagcatgggcttgttgattgatggatgatagaagagagccctgatgctgtggccgagttctctaaaaatagagccaagatggggattttgttccagtgatttattgggctgctcatgggaaaagagaagtgaaggaaccatgcttccttcctcaggcagggaaaaagcttggcgagagtgtggtctccgtggaagtcttcttcagcctggtatctggtggaattttgtaccaaacactgtagcacagtcagtcccatcttgaggcaagggggctgttctgtcgtgttccaggtcagtcagtgctgtgggatgacttgtgtctcccccagatttgtatcttaaagcctcacccccagtgtggtggtatttggagctatgggacctttgggtggtaattagggttagatgaggttgtgagggtggggccctcataatgggatttgtggatttctaagaggaagaagaaagagagatcattctgtctccaccaaaggaaggatacagcaagaaggtggccgtctgcaagccaggaagtgagtccttaccaggaattgaagctgctggtacctcgatcttggacttcccagcccccagaactgtgaagaaataaatgtctttttttctttttttctttttattttgttttagatggagtcttgctctgtcacccaggctggagtgcagtggcatgatctctgctcactgcaacctctgcctctcatgttcaagcgattctccggtctcagcctcccgagtggctaggattacaggcacgtgccaccatgcccagctgattttttttatttttagtagagacggagtttcaccatgttagccaggatggtctcaatctcctgacctcaagtgatccgcccgccttggcctcccaaagtgttgggattacaggcgtgagccactgtgccggcctaaatgtctgttgtttaagccacccagtccatggtattctgttatgacagcctgagctggctgatatagtcagttactgctgtaggctgctggggatggaggtgggaaggtagagtaacttcccaggtgaggaggcttctgtgcagttgaggacagttatctggacataggggtaactgtgagccattaacagccatcatacacagcacccaggggatgggtgcattggccagcatggaggggagctgggcagggtccaacagcatctggcacactcaagtttcccttggtctcctgactgtcttcctggtttcattgctgggactccagccccctcctccttggtcttggcaagacagatcagagaggagcgagcactaaaggttgtgcggggtccttcccagcagtgccaggccagaagtggccttgtggtgtttgtggaatggccccacctcatccagacccaagaagcatggtcagtattaggattttccactgaccatcagcccaggacactgccgtttgccctgagtgtcatatgttctttggaaatctcagcatctctagaggtcaaaggttttctaacttgcctggctactgaaattgagctcatatatctgttcttagtgttttggcaggtcaagatgagaataaatctgatcagttctcctccttttaaaaacccatcaatggtttcccattgtctttataacagactaaatctaacatggcgatctcattctttattcactgtctcctccccctttcttttaatccttggtcctctgcagactgccacacaccataagacatctgtgcgttctgtttagaatgtttgccattgccatcttctctttttctagcaattaactcttcctctcgatctcggttcatttttaccatctaataagcttcctccaacttccccctttcgtagacactcatggtaacctgagcttggccttgtgaaaggggtgattttatgttggatttgattaatgtctgcatctcatcacaaggcattagctccatgagggcgggactgtgtcttgccactctactcccagcacctagcaaggtgggcatcactaaatatttatgggctcaatggctgtatgtatgaatgagaaacccctggaggatcctgatagatagatataaggctttcactgatggtccccagatcagtgcctcctaaagtcaggaaatgaaggtcaacggattgtccaatttataccattattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttgtgtgtgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatcttattcaatgctttttcaattcagtatctacctatcaacataacaactgacatctattatttatactcccatctacattacagccacctccaaatgcttagccatgtccatcctcatatctatctcccaaaagttgggagtgttcttaaagaaagcagaaagaacctttttttttttaaatgtttctctttggaactcccattctatattcttaccattatattgtgttatacagaaactttttagactgaaacatctccctgacagccttaggtactcccaatattgtgatatttaaatccttcttaagatctgacatccacacatcaaaagaaaaagagtaccaaagaggctgagtgtggtggctcacgtcggtaatcccagcattttgggaggctgaggcggctgtatcacctacagtcaggagttcaagaccaacgtgacaaaaccctgtctctactaaaaatacaaaaattagccaggtgtggtggtggatgcctgtaatcccagctactcaggaggctgagacaggagaatcgcttggacccaggaggcagaggttgcagtgagctgagattgcatcacagcactccagcctgggtaacagagtgagactccatcttggaaaaaaaaaaaaaaaagaattgggaagaaaaagggcaatgtaaacaagaaaaaaaaatccagatagcttaatatttatttttgtttaacttttatttgaactttggtgggggggtacgtgtgcaggtttgttatataggtaaacttgtgtcatgggggtttgtgtaatattgcccagccatgcgtcaattgcagacagaaaattattataaactaggccgcgagggcccactagggggcagtctctgccttcaaagccattcctcctcggaggctctctcaggagatgccccaatttgtgaaaccacagtactgtcattgctcataatggaaggtgcagcagagaccagctacgctcactgaggtccagagaaaggttacttcttcaggtcacacacagatagggcccagttctggtagatctcccttcccttttacattattggtttgtaattttttcccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattcaaaatttacttgtagggtttcttttttttttttaacttttgaggtgaaatgtacatacaatgatacatacaaaattttttttttttttgagacagtctcactttgtcacccaagctggagtgtagtggcgtaatcacggcttactgcagcctcgacctcccaggctcaattgattctcccacctcagcctacaaagtagctgggactacaggcatgagccaccacactcagctaatttttgtagttttgtagagatggggttttgccatgttgcctaggctggtcttgaactccatggttcaagcaatcctcccactttggcctcccaaagcgctgggattatagatgtgagccactgtgcccggtgatgtcttaagtgtacaatggctgagttttgacaaatgcatatgactgtcattctaacccttatcaaattaattctcttttttgatgtcacagctgctgttgaggatccaagggaaggtatgaaccagagaaatgcctttatgtccccacacactgcactcatactcatgagctctggctattgggatgtctattatacctaaaatcccttagatgacatgaaacttaatagttgttcaattttttttgtttgttttttgaggagttataatgcagtaaagtagaaactttgaaaattggaaattcttgtttacaattttttgttatgtattcattgaagagcaaaatgcctttaaaaactcaatacacctgctttattttgctttttttttagtattgttgtaatgaagaagttcagttaaatcatatctgtctatggaacatctatcatctttctcagtgtattactgatagttgtctgcacaccccatgaggccaggggaagggtctcttgcccatccttccttcaaagcctatcagcttgttaggttgaggtgagtgtctcaggcactgaagttttgggatactggacctaaggagatgtagggaagctgacgtcttgctattcagtgttccttctcttcttccctggtcatttaagtctcatgagaattatcaaggccaggccagcgtctgaggccttcaggatgtgctgggcgcggtcattgctcccaaatgtctagggaattgcattgaagtgggcactgctgggacctgcagggctgtgacttgtgactgcctttggggacagtggtccagcaatgtctattaaaatatgtatacatatgaacattttgactctcacgttttcctttagggaatctattctcttaaaatgaaacaccagcgtgcaaagaaataaaatctagaacaagcatgtttattgatgttttctttgagatgcaaagaaaacatcagcctaatgaaggggtacccattttatgtgatactaggtagttgttgaaagcattgaattaggccaggcgcggtggctcacacctgtaatcccagcactttgggaggctgaggagggtggatcacttgaggccaggagttccaaaccagtctggccaacatggtgaaaccccgtctctactaaaaaaaatccaaaaaattagctgggtatggtggtgcatgcctgtaatcccacctgctctggagggtgagacacgagaatcacttgaaccctgcaggtggagtttgcagtgaacagagatcaggtcattcatgcactacagcctgggtgatagagtaagactctgtctcaaaaaaaagaaaagaaaagactgaattaaaatgagaaaatgagtataatttttgacatgggaactggttacacaggtgaatttcctttgtgagaattcaagctgtaagattatgatttatacacttttctataggtatattatacttcctatacttttattatttaaaagtttgtgataaaaattctaaataactaaaaacaaaacaccaatgggttagagctacagatattggtgtaaagcagaggttgccaaactggcctgctgcctgtttttataaataaagttttattggaacacagccacatccattcatttatatattatctatggctgctcttgtgatacaatggcagagttcactgcgtagttgtgacaaagcttgtacaatctgcaaaatgtaaaatatttgttctctggcctttactgaaaacatttggcagtccttgaactagaggaacatctatggttaagtgaaagggttaggttgcgtaaaaatatatttagtatgatctcattttgaagaaataagcaacagcaacagacacctcctatgtgtgaagttttgtctgtatattttataacctgtgtgtgaagaaaggtgtggaaggataccaaccaggttgtaaacactgggatcgcagcaggattgggagtgaagaggctgtggcggtgagggggattgtgttgtgtctctgtagttttcattacgtttcacaggttgattgcaatacatatcatttccgcaatttttgaaaaataaaaacagaaaaatctccaaataggaaaaatgaacagaaataaattgtctcaacaacaatagcagaaaaaaaaaatgaatggataatgccccaaatgatggggtgttggttgcttgaggagggttgttgggtggttctcagcttgagcagagctgggcccaggccctgtctgggtatttttgagtttttattgtcactagcttccatcttgtgtagcatctgccttgtgagctgggcctgttctccgagtttcatggtgtttgatgttttttgccttctttcagcaaggtcgctggcatcatccttgctgagtcgcatatgttctgggaaccacctcctcttctctgtgcctctcgcctggcaggtctacgctaaactgccccctgccctcccaggcccaccccacctccaagtctgagttctttgacttaaacttcaatcctgtttcccatgggctgtggcttcccaaccctcagtttcagttgaagctaatttttttttccagaaatcactgtgggccctggctgctctgggtgtggtctggggaccagctgcatcccatcggcattacctgggagctcgttagcaattcgggatctcagcttcccctccaggcctgctgaatcagaatctgcaatttaacaacatcccctggggatgcactgtaacattcgagcagccctgctgcagaggatcgcagtgagacgggaagaatgtgtcttttccactagatggcaggccttacctgcgcttggctcctgcgcagaccaccacaggtggatgtgccaggggtgatgtgaacctccagccccgcgttggccatggcatcttaccagtcatgaagctcgggtgtcagtcccgccagggctggaatcctctttcattggtgacctgcacctacctgcatgtcctggcctggtgcagcatgagcttctggcttgagccatttgtgtaaagtgacccagagcctttctttcttccctgctttgcctttgtcctctaccacctggaaggtgaaggcatgtctctggggagcttcctagtcattagcctctgtgttgcttttctggatggcttgctgcacgtctctgctaattttaggccaatgtggtctatgattacaaaggttttgcatgggctttggagtcaggcctgggtttgaatcctgcctttcccactcctccaacaagtatttgttgggggcctcccatgtgctgggcactgcttacaggcaaggcccctgtgctcatggcctctgccttctttctaatgatgggagatgaagaggaagcaaacaaaacactttgagaaaacaaggaacactatcaaggaaataaaataaagcggcatgatgtgatagagggtggccagtgggctgagtgtgattagcagggataatggcatttagttgagacctcagggaccagcaggagggagccagcttgctgaaaattccagggaagagtataccaggcagagggagcggcagaggcagaggccagagggaagagtgaagcagcaggcttgtgagtgacaggaactgacagccagtgggtgtgactggagcctcgggatggggaggggtgggtgacgctggaggaaaggcagggacagccagttaggctttgtgagccccatggtgggcttggtttctttctaagtgcatggaaatttagatcccaggagtatctgaaggacatcatgcaaggtcagtgtgtttaggccccaaaaccacccagtgggggcagtcattttgtttttctcattttacaaaggagaaaacagagccttgaaaaatctgagcctggtgtggtagcatgtggctatggtcccagttactcaggaggctgaagcaggatcatcagttgaggccacaagtttgagaccagcctcagcaacacagtgagaaaaaaagtcttaaaaattagctgggtaggcagggtgcggtggctcatgcctgtaatcccagcacttggggagtctgaggtgggtggatcacaaggtcaggcgttcgagaccagcctggtcaacatagtgaaacctcatctctactaaaaatacaaaaaaaaaattagctgggcgtggtggtgcgtgtctgcagtcccaactgctcaggaggctgaggcaggagaatcgcttgaacccgggaggcagaagttgcagtgagctgagattgtgccaccgcactccagcctgggtgacagagtgagactccatctcaaaaaataaataaataaaataaaataaaataaaatacaaattagctggacatggaggcatgcacctgtagtcccagctacttgggaggctgaggcgggaagatgacttgagcccaggagttggtggctgcggtgagctatgatctcgctactgcactctaggctgggcgacagagcgagaccctgtctctccttctaaaaaaaaaaaaaagaatttgagcacccgcctctagtccctaaggcagtgcatggaggaggctggatttgtaccctgggtccatctgtctggcaggttctaacacattaagtcagatgttggaaagatacagtttaagactatgagacattggaacataagaaacacccaccataccagtggggagaggaaggagatgcttcagcactggtagttctcatagtcttatctttcagtggctttagggcacaggttgggactagtttagccttaaggtcttggagaagacctgcttttcatttgcctgttgccccagcactgtggggtcagaatctttcttgtgatcagagtttagagaagggagggagcagtgggctggaggcattccaggtagccctggagaaggcaggagaggcataagttagaagggtgagggaagggaggagggccagtggctgacgcttactgagcccttgctgtgaacccagcacagtgctagccatcgtggggcacaaaagcctgtgcaagatgcagtcgcagctcctgagcagcctcgctgtctggttgggttccatctgctttaccactaccaacaaaaccaagggacggacacctcttactgatagtaaccaccaggcactgggcgaagcacgttgctcagccatgtcgtataatcctatcaacaacctgtagtcccagctacttgggtgggagagagttactgagggcatctccattttacagatggggaaactgagacacagagaaagaggttaaataacttgcccaagccacacaactaggaagatgtggagctgggacttgaatctaactatgccattccagataattaggctcttggacaccgtcttatcctggcactaagtacatcagtggagtgatgatgatacatgatattagtagcagccacttttacttctttcttttcttttctttcttttttttttttttataacagagtctcactctgtcgccaggctggagtgcagtggcacaatctcagctcactgcaacctccgcctccctggttccagcgattctcctgcctcagccttccaagtagctgggactacaggcatgcgccaccatgcccagctaatttttttgtatttttagtagagacagggtttcaccatgttggtcaggctgcctgacctcaaatgatctgcccacctcggccccccaaagtgctgggattacaggtgtgagtcaccgtgcccagccacagccaccttttctaaaacccttccaaatgcctggcttttgctaggaactctacaagcgttccttcaggtaatcctcctaacaacttttgctattacccgtagtccttctctccattatatggtgaggaaactgagactttgcttcatatgactccattttccccaacacttcctgctagcctgttttgctcctttgggagtatgagagtcagtgtttgctggactgtgaggctgaagatgataacatttcttcaaattggcctgttttttttttttttttttttttttttttttgcagaaagacagatttcactggccaagatctgcccaagaggctgaataaattcctaggttgtgagaagcaggtggatggagaagactttctctccaaacctccctgtgttaggaccagggaatgggttatgtgaatctggcaaccctgtcccaccctggacctgcaccctttaccactaccctggcacatccgggacctgcaccctttaccactaccctggcacatccgggacctgcacccttaaccactaccctggcacatccgggacctgcaccttaaccactaccctggcacacccgggacctgcacccttaaccactaccctggcacatccaggacctgcaaccttaaccactaacctggcacatccaggacctgcaccgttaaccactaacctggcacaaccaggacatgtgcccttaactattaccctggcacaaccgggacatgcacccttaaccactaccctggcacatctgggacatgcacgcttaaccactactctagcatcatccgggacctgcacccttaactactaccctggtctgcctccttgagtggcccagggaacatctagaagctgagagaaagagagggataaaaccaagttcacagcagtatcctaagaaagtgttctcacttaaaaatgcaaagatgctcacagagtgttcaggttacactggaaaactccagaaacaaagtggtttgtgtacatgggaggaagcagaatcaacttcccaccttagcattgtgggtgcttagcccacgcctgtgtatcgctcagggaatcagagtcactataagcatcatggaataagggatttactgtacacgttagaccttatacaagcttggagatgctggagacgggaagatctggaggggtgaattgagaatcagaggaagagcagtggtgcaggtggacaagtaggagttggtaggggatccaagaagccaagcacgttgagctgctgacatagatattgatgaatttcatgaagcttttacaggcactggtttcacccttgggtaactcagtacaggtatgttgacagccttccactaattcaaagatggttcataggtgtcccagaatcttttaattcccaagtgaggcagccccaactccttcagccatttactttctaatccttaatccacagcccacaacctcaaacacatgatagggccgagtatgccatcattgatgtcaacccggaactcttcctagacaacactccagttggagtagcttccttataaagcagggtgcccagagtgaaagagaatccacctgtgttgccgaggagcgaaggattgtcactttccttattctagatcagctgttttcaaacctttcggcttccagcccatctaggttttatgtaacacacacacacacacacacacacactgcacaaacaagcacaaactcacaaacacacacacattgcacaaacaagcacacactcacaaccaaaaccaaactgccattaatgcttacctctacttatgctcaccacacactctgatacattctcctctcttttgtggccctcttttctgttcatttccattctatttcctttaagaaaccctttaaggaaaatgctcttactctgcaaattgatttcactaacaattggcaaatgtgtcatgacccgccgcttgaaaaacactgtcctagacaacaaaattctctttctgcatcctgagatgatactactcttttggggggtctgggggtaccaccagccacattgcactgttgacttatcttgggtttatgatcagttaaagctctcttgtctatcacatcgggtgctgctagcctgcaggccccacatccttgtgcaagattttttttttttttgagactccaggatgaaacctgatgcatttcatcttgtagggtttggccttttgctccacggccaggctgagagcttttgggtcttcctgttcttgtgccgagtgtcttccggacatcaccttcctcacaccattctctgtgctacttgttctgccctccttacttttgaaaagatagtttattactcatagatgaggagcaggcgtgccactccatgaaaggccacacagggaagcagcagggtctgccaggaggcagaggaagcggaaagaaaacgtggcaggagcatttgctgctgtttctgtgagaaggagcaggtagggcgggaaaccagccttagggctggctggtttgaatgatctcagcagactctgggtgtagaggctgtctctctagttgcctggtacctgatacctggtgcttttacctggggtaattagcacaggctggcccagagtgtaagagccccatgaaggagttggttggaggtttgggctttggattggttggtttgcatatgaaaggtgcgcttgcaggtgagttctttactgtctctaggaatgggctagccctgggacagacagtttctccagggtcagcaaggctccgagacaccaaagcatcagaaatacagaaaatagagccaggtgcagtggctcatgcctgtaatcccagagactcaggaggctgaggtgaagaatcacttgaggcaaggagtttgagaccagtctgggcaacatagtgagacccctgtccctaaaaaaaattaaaaataaaattacccaggcatggtagtgcagcatgcctgtaatctcagctactcaggagactgaggaaggaggatcactgaatccaggagttcaaggaaagaggccgggcacagtggctcacgcctgtaatcccagcactttgggaggctgaggcaggtggcgagtgaatcaccaggtcaggaaagggagaccatcctggccaacatggtgaaaccctgtctctactaaaaatacaaaaattagctgggcatggtggcgggcacctgtaatcccagctactcaggaggctgaggcaggagaatcgcttgaacctgggaggtggaggttgcagtgagcaagcgagactccgtctcaaaaaaaaaaaaaaagacataaaattaatagaccttagactattttatttaattattttatcaaaataggataggcatagttaaaaatgccaatgtgcattggagagctgaggatgaaaagcaatgtcctgtacttgagcttgcatcagaatcatctagagagtgccccaccctcagagtttctgattcagtagacattgaagaatgagaatttgaatttctaacaggtccccagagaatgctggtgtgttcacactccggttaccagaaagggatcccgatccagaacccaagagaggttcttaggtcttttgcaagaaagaattcgaggcaaatccataaagtcaaagcaagcttactaagaaagtaaaggaataaagcatggctactccacaggcagagcagccctaaagctgctggctagccacttttgaggtcatttcctgattatatgctaaaaaaggggtggatttttcatgagttttctgggaaaggggtggcagattcccagaactgaggattcctcctctttttagaccatgtagggtaacttcctgacgttgccatgacgattgtaaactgtcatggcgctgctgggagtgtctcttagcatgctaatgcattacaattactgtataatgagcagcaaagacgaccagacgtcacttttgttgccatcttggttttggaggattttgacctacttctttaacacaacctgttttatcagcaaggtctttgtgacctgtaccttgtgctgacgtcctgtctcattcagtgacttagaatcccttaacctcctgagaatgcagcccagtaggtctcagccttattttacccagcccctattcaagatggagtcactctggttcaaacatctctgacactctgagaaccactgcattggaagacactattttcaactctttaaactctttcttccagcacttgagctctaaattttaatcatgtgctctgtctctctgtcatttcactatttcatggctctgacttcctgagaaggttttaattctctgatgtgatccctctagttctcttcccctcacatccagcacggggttactgccatttgtagttcactcactcaaaaaaaagtgattattaagcatcttctgcatgtcaggcattgacttagtcactggagatttgtcagagaacaagccaaagtcctgccctcatggagcttatattttagtgcagggcttgacaaactttttctgtgaagggccagatgggctttggagctatctggtcactgtcacaactacttaactctgccattgtaacacggaagtggccacagtgtgccaatgaatgggcacgggtgtgtgccaataaaactttatttacaaaaacaggcaggaggctggatttggcccttgggctgtagtttgtagacctctgttgtagtgtgggagaagacaaagtaggtaaataagtaaaatacgaacagtaagctaaggggaaaaagaaaaaacggaaaaagaggatgggaaggaggcaggaggggactggacctgcacatttagatatggtggcaagcaggcagtcactgagatggggacattgagtaaagactttcaaaggagatgaaggagggagccatgcatctccctggcagaagagcattccaggcacagtaacagctggtgcaaaggccctgtggcatgagcatgttcggtgtgcttgaagaaacagcaaggaggctcgtgtgtctaagtggggcaagtcaagggaagggagcaggagaggaaagcggaggaaacagagaggcagctgctgagggctatgtgattcttgggagggaatttgtcttttctcttagtccaatgggaatccattattgtgactctagtagttgtaatagttcctttaagttttatttatttattttagatacaggttctcactgtatcactcaggctggagtacagaggcacaatcactgctcactgcagcctcaaactcctggcctcaagcaatcctcctgcctcagcctcctgagtagctgggactgcaggcacacaccaccatgcccagccaaatttttaaaaattttataatagagatgggatctggctatgttgcccaggctagtttcaaactcctggcctcaagtgaccctcttgcctcagcctcccaaagtgctgggattacaggtgtgagccactgaacctggctatttaagttatgtatttgcaactccatttcttgctttcccaatggtaggcaatatctcttaactttgtcttttgtagagcatttttatatgcatgatatcatttactccctatgagatgtgactattgtccctattctgtagaggaggcaactgaagctcggaaaggttaaatgacttggccagattcatatagctgataagtgctggtgctggaatttaaacccaggtttgtcttaatatggagatcttagcacctattttatatgaagagacaatcctttagggatactggggaaacctgtggcttttggacaataaattaaaaaccctttcccaagaaggggagctgtgtgtgtatcaatcaaacaaaatgagaactattctgagagggaggaaaaggttcttttctgtgggaacgctgaccaagccgttgacagctcatttatgtgatgctggtgcagtttgacattcatagtacaagacttgcatgcaattagcacgaatcgttctaacagtctcttgaaaacatttggaattttccctctgtctggccttgtgcatgatgtaaacatggctttatttagttggtcatccatcccagaatagtgtggtctgcatctgtctgcatcactgtggtctgattgaggtcttgttttcctggagggcagagactgttgtgtaggcttgctttgtggatcctcctcccccaggatcattcgccacaaacccgatggcagcctctctctttagctcatgacaatttctccaagtgtaagctgggggtcccgttcagtatgcaatgcaaatgagatgcaaatgaggggccctcttgggcacaggccaggaggccagagctctggggacttctgtacccctcctctgagttgcctaatgaagctgaccgttcctttcacaatcatcttctccacccaccaaaggcctcttaatgagggcagaagctgactgctctgaaaccccttcagacacctggtgattggaagctggagagacagtgagctttagatgggctgtcagccgctgctgagtcctcatcagctgcctgctgggttctgagaagcactagggaaggaagggagatggccctggaactgactgctattgtctgttcctcctcccctgacgagctgcatgcggcagccacggatggctgggtttgggctttcacgtcggcttctctggcccttgctggatgcctgcttcagctcagagaatgtggcttcacagggacttggaataagagctgagagcctgttccccccatcgaggatcaatgctcctttgatttcatttcttctttccagacgaatccactgtcttagcccgttgttggagaaatcccgacctaagcaggctttcaaattggggaaagaaaagtgaaccaatctgaaatcatggaatggttggtggagaaggacaagtaggcatatccataaagagccagcagtcccaaaggatgttccagtgcatctttctgcttatttcttctagttttgtaggggtgtgtggtgtgcaatgctgtttgcttgacagaatcctttcagtctctctctctctcgaaatataaatttcctgcactacaacagcctactaagtgccagacacagtgctgggctctttacctgcatcaacccattttgtctccattgacaaaaggggaaactgaggctcagagaggttaattgacttgctcaaggtcaactgggcttctgtgtggcagaactggagtttggtcccaggtctgtttgcatctaacacccagccccttaaccactttgccgaattgagaatttggaaattaaaatggtgatttcaactcagggatgggtgtgctttctttcagccttgcagtaagtgcacatcttctttctcttttcctctttgaagctgccagcctctcccttggggttctccttggctctggccatgatttccccagcttcctcattcatacctcctggcatcagactgacctgggctaatcaccatctctgcctgtcactagttcaagaggcagcttatggggacttgtgggtcatacaggttcccctagaaagatgatgggcagactgacattgggattgaaatgtcttgtctccagcgttcttgaataggggcaacaatgcccactgggtctccaggcatggggtctaaaagtgaatgcaaaatacctgtgatacagtgtggatgttttatccccaccaagtctcatgttgaaatgtgatcctcggtgttggaggtgaggcctcgtgggaggtgcttgggccatttttgggtcatggggcagacacctcatgcctggcttggtgcactccatgtcacctaaacgagttctcgctccatgttcactagagatctggttgtttaaaagagtctggcacctcccctctctcattcttgttcccgctcctaccatgtgatacacgggctcccctttctccttgtaccatgattggaagcttcctgagtccctcaccagaagtggatgccagcaccatgcttcctggacagcctacagaaccatgaacaaaaataaacctcttttctttataaagtacccagcctcaggtattccttgagagcaacgcaaacggatgaacacagcctatttccatagccttgctattggtgagtcttgggcccgtggtgcatgcacaggggccagatccagcccttaccccaagagcagattcaaacgtgtctttccctgattatttatggccactaaaatggaaggtgatggttgtggtgggtgtctatgatcagggctcaataaatatttgttgaaaacaaaaatgtaaacaagaaaaagacaggaccttgtcaacaagtgttatatagttgcagatctttatcttggattgttcagactctgcccttctctggcaggcacacttttgggaatgggaagggccaacagtgcttctttggtcccattagatccccatgtcagccctatgaaataatactatcccatacttactactatttcagctttacagaagggaaaaatgcagctcagagaggtgaattcacttgcccaaagtcccatcgctagggagcgatgggatttgaattaaaaatgcagatgtgattgattctaaacgcaggctgttaatgcatagctttcctggggaacaaaaagagctttcctttcatacctcattcattcattcattcacttattctttaatctcttctgtatgggaggtcatttgctagatactggatggctgtaggaatgaatatgattctttacacgctgagtatttcatagccctactaagagagaagaagagagagctcactataaaaggggggattggtgaagagataatggagtaggaagcacatgctgtgggaggtgccaggggatgagaggttaattccaacccatggggttgtgataggcttcacagaggcaaaggcagtggacttagttctggatggggcagagatctaacgcttattgatggcttgccccttgctaggactcagctcggtgggcgctttgtctattttctactttgaaagatgaatagaaactttgacggtcttttgccctctgaaatccactcttcacacccagccacaggaatctttctaaaatgtaaatcaggccatgtcacccccctgcttaaatgattccaagccttctcagagcttccaactgaaacctaaactcctcactcctgctctaagagcctgcagattctgcttccttcagcctctttccaaccttgtttgttcttttcccatgatagccacatctctgagccaacaaatatttttccttccttcttgcacttgctcttccctcagcttgggttgcttttccttgggctctatgtgttgccaactttccagtagccttcagtcatcactaaatgtcaccttctcagaaagcccgcctctgagtcttatctgaagaaacccctcccagtcactccctatcccattactctgtttgcatttgtttatttatttgcttcttgcctgtttctctccactggatggagagcaagaaccttccttattttttatgccactttgtgctagtgcagtgcacaattgacatgtacagatgcacaattagagtttgctgagtaaatggctaaataggttaaaaaaaaaaaccaaaaacggtgggctgctaggcagaagtgtaaccacacaagtgaaccttgaaagttaccatgaaacgtaaccttcatgccctgtgaaggtgccttaggtttctggtgtgtttggaccatagattgtagctatgaagtctgattaatgcctgaatcagacattgaatgacctgaataaatagttaaaaagttggacttctaggctgaagtgtaaccacatgagagaagcatgaatgttaccatgaaggtgcctagggtttctggtgtgttcagaccatagattgtagctatgaagtctgattaatgccagctcacagaagagcttgctcaagcatgctagggatttggtgagccattgtaggtggtaatgacctgatctagttaccatgggtgacaattaaaaagaaggattaaagatgtaagggactagagctgtagagacccatccaggagctattgatccctgtaggatggaggagatgaaacatacatgaattaaggaagtggaaggataagaataaattgatgtagaggatcagggagaggatggaggagtcaggactaacagagatttctgactcaggaagacatgtggatagtgagcgtgatagccaattagggttagaagtcacagaagcttaccagaagggaaaggtaatcatcttgctttagtatatgttgagatgtttttgggttgcatgggtgactgtgtccagtaggcagatgaatctgtatatccagagatccgattggaaaaacagagccaacagtatggatgcaggggtcaccggccctaacagtggaagctgaattctttgagtgggtcaggaattagtgcagcactgtaagagcaggaaggttcaggctctgggaaatggagccacttcagtcatcagtggagcaagaggagccagtgaaggagaatttaaaaataatgcttttaagtccaggtgcagtggctcatgtctgtaatcccagcactttgggagtctgaggcagaaggatcgcttgagcccaggagttcaagaccatcctggatgataaagggagactccatttctacaaaaaaaaattttttttttttaatgtagccagtgtggtggtgcatgcctgtggtccaagccactggggaggctaaggtggaaggagcccttgagcccagaagtttgaggctgcagtaagctatgatcacagcactgcactccagcctgagtgacagagtgacaccctatctcgaataataattattattagtagtaataattatagtgcttttagagaatgaaggggaaccagccgagtaaatggtcatagaagccaagggaagagagaattcaagaaagtggatatggccaacaccttagatgctgccaactggtaatgataaacacgaggctaagaattgaacagagtcactggatttggtcatttaacttagggacttgggaagtgctctttcagtggcatagtaggagttaagaggcaggatgccggaaagcctggatgctggatgttgaggagggaattgaaggaggggatgtggaaagaggagtgtagacaactcatgagaatttgggttgtggaagaaaggggccagggaaggcgtcttagaaggaagttatttctgagaggcatctgagcaggtttatagcatgaatggaagaaagcaaggtgcctgggaatagggataggaattaagcagaagcggtcctaggctttgtcttcaggaagataggtgttcaagtcccagctctgccacatgctggctgtgggactttgggcaagttaatgaagccccatgagtctcagtgtcctcatctggcgagcagagagagtagcctgtaccttgcagagtcatggcaaggatgaaacaagaatgtctctcagggccttcacagcgcttagtgcataatgaggggttagttagtgaactcctaccaagctcctttgtacagggcatttagcaaagacgtcagtgaccctgagaatccctagtctaaggtaggtaccccttccctaagcgctgaacttcctcccttatgcatgtatcacatctacaatgtttccttgtgtagtggatactgtggtgtgccaccaggatccctctctcagcacagaggcactcctgccccaagccacgcagagtattggctctgaccactcacggcttcagtatttccgtaggatttgccctgagggagctgcagtgcccaaggttatgccctcttccaggggcagctcacagtctatgattggttgctggtggggaatgggcttataaatgctcttccccagcctcagtagggaacaagtctaaggggccatcccagctacagagctccctcatggatcaggtgacacctctgttgcagctacattgcagttcagtttctcgatttcatcctgcttcccccattccttgcaggagttcctcccaaggttattccctgagaagccgcctgcatacaatatccagatcagtcttttttcagggaacccgacttaagatgccttgtttaatgtttgtatcttttctctaaaatataagctttttgtagggactgactattctgtcttgttcattttgtgtcaccatgtctaggtacataataggtgcttgttaataatttttaatctttttttttttgagacagggtcttgctctgttgctcaggctggagtgcagtggcatgatcttggctcactgcaacctccgcctcccgaattcaagcaattcttatgcctcagcctcccaagtagctgggattacaggtgtgcatcaccacacccagctaatttttgtatttttagtagagacggggttttgccatgttggccaggctgatctcaaactcctgagctcaagtgatctgcccactttggccccgcaaagtgctgggattacaggcatgagccaccacatgcggccattaattgaataagtgaatgaacaggtttcctaaacacacacacaggagtgccctgatatatacagtttttcagagttgtgattagagaataggttatctggaagtgccttcctgtgggagtgtgagcttgcataggctcccccagcatggagccatcactagcaatggctgtgtcttccacgagctatttccagggttccatcagcaaacagtggtcacgatttataaaacgttcacacaagaacatttgggctgcattctacatcattttagtacagagaggttgttccttggggcctttaattttctagctttcattattgagagagtaaaatgtatcacttgcattccaaaattgatttttatttcccaaaagaagcccataaaaataaataacttcccgggagggaaaacagaaaagcactctatacactgggcaatttgttaaaaaagaaaagaaaaggaaaggaagcctggagcgacaaagcaatctaaacatttagattgtatctcttgtattcccccactccccctgcaccttaaataaataaaaaaaaaaaaaaaaaaaaaaacttgaggcctgctggactttgaaaatgcccatgttgttgagaaaactctgttgggcagcttcatgggacagcatcctttggagcactgcctcatggttcacacccctggtatcccaacccactgctatgttgttattagcaagatacgtttccagtatctcattactaattgtatcagtaagcatttgctgtgtaacaaattgctgcaagggtagtgggcttaaaacaacattctttctctcaattttgtgggtcttctgggaggttcttgtgatctgggccagcttgtctggggctggagggtctgtgaggccctcactctcacatctggtggttggctcagtgtcagctggagggacagggatgccttggccattgcctgccaccacccagcaggctagcctttgcctgctcactggcatctcaagagcagtaagtgagggcatttcaatccaagccccaattcccaagcacttttgaggattctgtttgcatcgcattggctaatgtcccagtcacatgaccaaacccagatgcagggaatggagaaacgaattgttgttctttccttgacattttactttctcaagtataaaggggggtttgtaggcaaggaagatgccaagtagtcccattttatagctaataaactgagaaccagagaggttgagcaactggtctgaagtcacgcagcaagcccagaacacactgggtaaccaatccactgggggtgagttcaccctgtgcagccacatttgatctccccttgcttcattccctccagcactctggcagccaggaggacagctccctgtggggactgtgacattactggcccctcactcagctcttcttgtgccaattagaatgcatacttatttttttttgcaggttgtcctttgcttgcatccctcacctcccccatccactctgtgatcttctctgtggctcaagagcctgactccttcagagtgcatgacatgggctcttttcctttttagtttctgattgagttcaagcagtaagaggcattgattggcaagagattgtaggatggtaggaatgagaagatgcggcatttctgtcccaattcctctgctcttggctgtgtgtccagcagtatcagaaggccccttctctgtgtctccagatttcactgggctctggtaacactacttccttctttggcctcttcaggcctaggggtagcaatgacatctcaatgctgctactctctggatgtctcaccatgcgttgttgatccctttaaccctgtcttcacatttgtgagtagtaccttaattaaaatctctagagccttctgaattggattctgttttctgcttgcgcctatcctgatacactttttttttttttttgagatggagtctcactctgttgcccaggctggagtgcagtggcatgatcttggctctctacaacctccgcctcctgagttcaagcgattctcctgcctcagcctctcaagtagctgggattacaggcgtgtgccaccatgtctgcctaatttttgtatttttaggagagacagagtttcatcatgttggccaggctggcctcgaactcctgacctcatgtgatccgcccgccttggcctctcagagtgctgggattacaggcgtgagtcaccatgcctggccactgatgtactttcactgggttccattttttttataaggggagaaagaatggagtttgcagcatgcgcttagggaacccagtatcatgatgatagaggagtgagtagcctgcatgaatgctgctgtggcaggaagaatgtttgagaacttgagcactagagtgtgagatttctggttgtcttggctccattcagggaattcttaggactctgggaaggacataccaggatatttatggcatcactgtttgtggtggcaaaaagctaatagcctcctgaatgcccgtttttgaaggctgaacatgttgtagtctgtccatgctgtggtataacttgcagttgaaaaagaatgagtttcaaactgactgacatattgttgggtgggaaaagcattttgcagagcagcgtgtatagtgtgattccgtttttgtacagtaaccctcccagtccatttgtttctaggtgattgtctcagccaggagaaaggtaggaaagagtaaacaccaggttgccgtccttcttacctggcagttggggaggaggagaaagatagaatgggaaagcaagtaggtaaagggagcttgaaaaaaaaatcatagcaaatgggaacatacacatagatttaatttggtgtcccttttctaactttttgagatagatatagcattgatttttcagcctatcttctttcctaatatgtacattaaggctacacattttcctttaagcacagctttagttgactctcacaagttttgaatatttttgaattttcatgatgatttttcctatgatttattcaaaagtgtatgtttaattttcaagcatttgtaaatattctagttatctttttgttattgatagtttgtttccaccacagtctgaaaacatacataatttcattcatttgacatttgggtaaatattccatgtgcacttacaaagaatatgtatcctgtgtttgttggatgccatattgtgtgtgtgtaaattagtttcgttagttgtgttgttcatattttctatatcttgtttgatttttattttgcttgcttgttctgttactgaaagaattggatttaagtctcctattatgattctgggtttttttcctttcagttttatcaatttttggtttgtatattttgaagcaatgttattattataaaatataattgatatctcctcggtgaattgatccttttatcattctgaaaggtatctgtttatctcaaataatgcttcttgccttaaagcctactttgcctcttgtaaatataccagttttcttttggttgatgttttatgatgtgtgtgtttatatgtatatacatatatacatatatatagaccgaatatatgtattatatatgttttatataatgttttatggtgtgtgtgtatatatatatataaaaagactgaaagggaaaagggggaaatatatctatatataaaataatataaatatatatatatttttcccccttttccctttcagtctttctgtagccttacatttagagtgtgtcttttataagcacaatttttaatacagtctgacaatagttgattttaattggagcatttagaccatttacattttatataattgctgatatatttgagtctatatctaccacttcctatgatttttcgtttgtcccatgtgttttacattcctttttctctttattattgccttttggggatcacttaagtatattttattatttcatattcctttctattaactaattagtcatgtattgtttttattatttttatattgattctagagattgcaatatgcatctttggattttagaatttaatatattagtacttttattacgttccaaatgatcctaggttctttaacattttagtcctgtttaccccatcctaccatacacattgtaattttacatgtgatttaaactacattatgataatgcttcatataatcagcatttacttggatttaataatatatttaccctttctgttagttttcattctttcttacattttcacatttccatctgggatcattttctttctctctaaagaacgtcttttattatttagtttaggcctgctgcaaatacatcttaagatacttgtatttcaagctgggcacagtggcacatgcctgtagtcccagctattcaggagtctgagacaggaggattgcttgagctcaagacttcaagtccagtctgggcaacatcgtgagatcccatctctggggaaaaaaaatctttatttcacattcacccttggatagaatttgaaactggctgttattttctttcggcactttaaatataccatcccgttgttcttcttccatcatttttgttgattttgtcagtcttattgtggctcttttgaagtcctattgttgcctttatgcaatctgtatgattttagattttctctctctctttgattttcagcaatgtgactgtgatgttcctgtgtgtgtgtgtgtgtgtgtgtgtgtgtgtgtgtgtttgtatgtgtttatcttggttggtgtttctttacttcttgcctctttaacttgatgtttttcattagtattttcttgtccattgtctgccctatccttttctctccttttcatgcttgactttgattatatgtatgttagaccttggtactgtgtcctctgtctctgacactctcttctgtactctctgtctcttttaatctttatgccatagtctgatttttcttaataatctgtttttcagctcactgatttgccttctaactgcttccaatctgctgctaagccatgcattgagttattaattttaagtattgcattttaaataaactttttattttagaatagttttagatgtacagaaaagttgcagaggatagacttcccgtatacctttcactcagttttccattattaacacgttacatgaccatgacacatccgtcaaaatgaagatgttaacactaattagtactgtattgttaactaaactccaaactttatttggattttccttttttttttcacgatattcttagtgtattccaggatctcatgtaggataccaaattacattaagttgtcatgtttcctaagtgtcctctggtttatgacaatttctcaatcgtttcttatttttcatgaccttgacagttttgagaagtactggtcaagtatctggtagaatgtccatccacttgggaattattgtatgtttaattctaaagctttcatttgctttatttagttattttgagacaagggtcttgctctgtcacccaagctggagtgcagtggcacaatcatcactcattgcagccttgaactcctggcctcaagcaatcttcccacctcagcctcctgagaagctgggaccacaggtgcatgccactgagcttggctaatttttaaaaatttttgtagagatgaggtctcgctgtgttgccccaggctggtcttgaactcctggcctcaagtgatcacccctcctcagcctcctaaagtgttgggattacaggtgtgagccactgtacccagtcagtttcttttttgtaaccaatagttctctggtgaaactttccacattgtcatcctttctcccttcttttaaacatcttaataagttattttaaagttcatgtttgataattccagtgtctgaatcacccatggatctgccctcttgtctgtttttttaaaattttttagacgggatcttattctgtcacctaggctggagtgcagtggtgcaatcatagctcgctgcagcctctacctcctgggctcaagcaatcctcccacctcagactcctgagtagctgggactatagatgtgtatcaccacaccccactaatgtttgtatttttgtagagatggggttttactatgttgtccaggctggtcttgaattcctgagctcaagccgtctgcccatgtttgcctgtcaaagtgctgagattacaggcatgcatcaccacgcctaggtgttttttgcttctggtcctatttcttggcatgtttggaagttttgtttgaatttcagatgattccttgctaaattagaaagctgttggacaggtgtggtggctcatgcctgtaatctcagcactttgggaggacaaggtgggtggatcatctgagatcaggagtttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagactcaagagaaaaatcaatgcctagcgttgagttcacttctctgctcttcccctcccactatgatttggcccctcaagtcctgccttccctggaagctttgattcctagccccaagaataagcttcaagctctggtggcctccctccttcttagcaggtgccctctgtctagcttcttagtcctttgccctgtgttgagaattgatttatggcccaaaggaaaaaaaaaaaaaaaccacacacagaatattggacttatcttaattctaattccttcaaaattccagtttcttgaaaaatattttttatctggcttttatagttgctctcagtgggagagctactttatcattgccccaagtggtatgatattaaataaaaatataaaatacaaaatagatttagagtggtataattatgtaaaaattgaatgttaacatggaaaaagaccagaaggtgaatatacaaatgaaagcatttatttaattttgggataagatctaaggtaatatttgtttggttcagaaaattatttttaaagaagggtgttgtgagcatcagtgatagagtgaggaatcctcatttctttcagatcctggtaggggaccctgagaactttggggagtgaagatagtgaagtaaaggttgctaagcattctgctagaacactatggagacagcgatataaaataagagccaataataacaaagtagcacatagtgaatgtttaccatatgccagacattctattaatttataatgattgtaacattcctatgagccaacatccttatcattagccccattttttaaacaaggagactgagttaccgagaagttaggtaactttcaggtcacaaagctgctctatggcagagctgatctgccaggatctctgggtttaagctcctcaccatcacacttgactaatttggtatagaaagtggctttagatcagataagggtacatgaaatgcaggaggtgccgtgttagaggacagtttggtccagtccccatgtcctggggcaaatgaagcagatggcctcagaacagcctgtttttaaatcatgtaagactgacttctttcagctgctggattcctgcctcccagagtgagacgttgaagtttggcccggaagaggctgagcactggggacgagcagtgctgtgctgtgtatagagtgcttaaaacagtgcctgggtctgagcgtggtggctcatgcctgtaatcccacctctttgggaggccatggtgggaagattgcttgagcccaggagtttgatttcagcctgcaacatagtgagaccccatttctacaaaaaattttaagaagtagtcaggcatggtcgtacacctgtagtcccagctacttgggaggctgaggtgggaggatcacttgaaccccaaaggttgaggctgcagtgagtcgtgattgcactactgtactccagcctgagtaacaaagcaagactttgtatcaaaacaaaacaaacaaaacaaaacagtgcctggcatatagtatgtgctcaataaaagttgtcattgttattgtcatgacatcatcagagcctagaacaaatcacaaaacctgtatattctctctgggctggaggtcttaagattcttctccattcccaacgggtactcccgagatgacgtgattcatggccattccttccttccttcagtgtgtggctcacactgtgctgggctatggcgtcaccactgtcaatacgacaaataaatggataattacagcaaagtgttaggactgctgtgccagacacgagtgcaaggtgtcctgggcaaccagggaagggacgttaacttacactgggattggggccctgtgatggtaagcttttcatcttgcaggaaaccaggggatttttttttttttttttttgagacaaggtcttgctctgtcgtccaggctggagtgcagtggcacgatcttggctcactgcaacctctgcctcctgggttcaagcgattcttgtgcctcagtctcccaagtagctgggattacaggcatgtgccatcactcttggctaatctttgtattttcagtagcgacggatttttgccatcttggccaggctggtctcaaactcctgacctcaagtgattcgcctgcctcagcctcccaaaatgctggaattacaggcatgagccgttgcgcccggccttgaaaccagggaatttaatgacatttaaaaatcatttattaagtatatatgaaatatatagaaaatagtatcccaggcacctaatagaacagaataataataatgactaggagttgttgagtgtaaaataggttgcagtcattacaacgcatataatagcatgaagtatatagctcctcagccctctcagccatcttatgagggaacactgttgctattctcatattacagatgaggaaactgaggctcagagaggttaagtaatcctccaagcctccgcagccaggaagtggtatcactttgaactcaaactcaggtctgtttgatcctgaggccaagcccttggccagaaaaattaggaagtcatagtcccttcccttaaggagctctatttaatatagcagaacaagtaaagcaagtacatatctctctaaagtatactgtgtcactgaagataagaaaggaagaaatcctgtgatgggtcagatgaagtcaggaaaggcttctgggaagaggtggccttatagatctaactagaaggatgaatgagctttgggccaaaggcaagggagggaaccatctggacaaagggtagttagtacacactgtgacctgaagagggagctcaaagcccccctccactccagggctgatgtgaggatgtgagttaaggacttggatgctgctcttggggctttcagagataggggaggagcttaatgacctcgtcttcatgatataccctaagcattctctcttggctttccatttgagacttactctgccttcagacctctcagaactctgcatatctggtatggtaagaggagcctgagctacctcttctctgcattgccttgaaaacaaaacatggccgggcacgatggctgacgtctgtaatcctagcactttgagaggccaaggcgggtggatcgcttgagctcaggagtttgagactagcctgggtaacatggtgagaccctgtctaaaaaaaaaaaaaaaaaaaaaaaaaagacaaacaggactggggaaaaggaataagaggagcccgtccaaccttccaatttccaccaattttaatgtggatccagaattgagaatgctagtctagctcaactcaacagggccagtggttctacttgtgattgggggtaaaggtcctagggtagtaaagagagtgagtacctgcctggcttgtccgctctgcacatgtctctgggcagtagctgtgggatgtggtcctggacactagatcccatctgtctcctcctatggaggcaggatcttacagggaacagccggcagccaaggctagctggagtctggcctacaccatataaggagatggtgcaggaaaggctgaaagttatggtgggggccgaagagggcgttgagttgcagtaaccatgcccaagcctttgtggagttaatgatcacagtggacacattctggaggggtcgtcggcatcactgggccctgctccaggatctcagcaaggatgttattattatcatgagggtgcccaattcagtttgctacttgtttatgggctgattgcaatttggatagagtttaacccccaccccacccccgccttttgtttttaaaaatttgctgaggtgaaattcacatgacttaaaatgatctgttttagagtgaacagttcagcggcatttagtacatgcacagtgttgtgcaaccaccactgctatttagttccaaaacatttccatcattccaaaataaagccccatactgattaagcagtgactacccatccctgccttctcccagcccctggcaaccatcaatctgcttttgtttttaatttttttgagacagggtgtttctctgtcacccaggctggagtgcagtggtacgatcatagctcactgcagcctggaactcctgagctcaagcaatcctcccacatcagcctcctaagtagctgggactgtaggcatgcaccaccatgctcagataattattatttttattttttataaagatgggggtctccaactcctggcctcaagtgatcctcccacctcagcttcccaaagagttgggattacaggtgtaagccaccacaaccagccaatctgctttctttaactctctctttctctctctctctcttttttttttgagatggagtttccctcttgtcacccaggctggagtgcaatggcatgatctctgctcactgcaacctctgcctcctgggttcaagcaattctcctgcctcagcctcccaagtagctgggattacaggcctgtgccaccagaccgagctaatttttgtatttttagtagagacggggtttcaccatgttggccaggctgatatcgacctcctgacctgaggtgatccacccgcctcagcctcccaaagcactgggattacatgtgtgcgccacgcacctggcctaactctctctctctttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccaccagatgtcctctgcctctctggccttgttagtttcttctccaagagcccttggatgtgatctgataatgaaaaggtgaatgtctagttcagtgggagccttcacatctaccccagggctttggctgtctccaatctgatggataaaccgcttgctaaatattttgactatcagccctgtgattaaggtcaggattagaactgttgtatttgtaagaacctctcctaaagatggcctcccattgcccacctgtttgaatcctacctgccttaaacatttttgccatttttatttatttcttagaaacaggatcttgctctgtctcccaggctggagtacggtggtacaatgttggctcattgcagcctcagactcctgggctcaagtgatcctcccgcctcagccccttgagttactgggactacaggcgcatgccaccatgtctggctaatcgtgaaaattgtttttgtagagacaaagtcttgctatgttgcccaggctaatctcaaattcctggcctcaagtgatcctccctccttgacctctcaaattgctgggattacaggtgtgagccattgcgcctggccggttttttaaatgtctcagtctaaagttcaatattcatcccctagcccctaagccatgtttttaacacctcgataaacgatgtgctgactttacctaaaatgtgtccagtattccttctgagatggaaagatgctattttgggggtaaatatgttgatcttttccagaaggagtccaagacagctgatgatagcttttgcttgttctctatagaagagcaagtgatggccgggcgtggtggctcacgcctgtaatcccaacactttgggaggccgaggcaggcggatcacgaggtcaggagatcgagaccatcctggctaacatggtgaaaccccgatacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcgaagctactgccatagaatgtgtgaccatggttatggatttcataaggggcaccctaagagggaaaaataatctgacccagatggatcttccgaggcactgtgatgtcgtgcctaagagtgcagccttgggaggaagacagagagggttcaaatcccgctctactgttatcagctctctgtataccttggacaagtcactcaaccccctcagctgtcaggttccacatcagtaaaatggggaaaacagtaacactcacatcataaggttcttgtaaggattcaatgagataattcatgtgcagtccttagaatagtgcttggctcatatagtaagagctcattcaccgtcaactattattatttaatctattttctatcatattttggaataaaacattttggcttactaaaaaagaacaaaaagaacatgtatttaaaatcagtaggcaacagtgagtcagtgaggatgttctgagagtaggaatgacatgataagatctgcgttctgggaagattaatttgtctgaagcttatagggtgacctgaaaggagacgaggaggggagggaaatctgtaaggaggctgatgcaacggtctaagctgctttgtgcaatatggcagccactagccacgtggggctgtttaaatttaaattaacgagcttggcctggtggctcacacctgtaatcccaaaactttgggaggccaaggtggaaggattgcttgaggccaggagtttgagaccaatctgagcaacatagcaaaaacttgcctctacaaaaaataaagttagccaaatgtggtgggatatgcctatagtcccagctactcgggaggctgaggcagaaggctcacatgagcccaagaggttgagactacagtgagtcatgattgcaccacgcactctagcctgggtgacagaacaagaccctatctcaaaaaaaaaaaaaaaaaatttaattaaagaaaattaaataaaatgcaaaactcaatttttccaacacaatagccacatttcaggtattcagtggcctcatgtggctagtggttactatactggacatcaaacacttccattattttagaaagttctattggacagtgtaactgtaataggttcactgcccaatgcatgcagcaagtcaatacactaagccactgagttgcagcagagaaacaggtttaattgtagggaagagacaggaggaaacctcaaatccatctcccagaggagtctggggctaggatttttaagggttttgcagtgggctgaagtgtggagattgttgattggtggaaaagagcaggatggagtcatgggacagggagataaagaagctgtgttctcttgctgattcagttcctctgtttggggtctttaaactggttggcatcagctattctgctggaattcaggatctgtttaagcaactcttaaacaaaagcctatgattctaatgtcagaaatcctatctgtaggaacaacgaggttgcaaatggtcagtatccagtgttacctgacttttagttgcaaggaagtgggtcaaagttagcctgattaatgctgaattgtaactatatttctgtccagaattcttcctaccctggtgaggctggcttcaacaacactggtcaaaagcagtggttttcatacatgagtgtcacatcagagtcatctggaaagtgtgttaaaatacaggttgctgggttccatcctcaattcagcaggtctgagcagggcctgagatcatgcatttctttttttttgtttgttattatactttaagttctagggtacgtgtgcacaatgtgcaggtttgttacctatgtatacatgtgccatgttggtgtgctgcacccactaactcgtcatttacattaggtgggaggaataacattaggagatcatgcatttctaatgagttcccaggtgatgctgacgctgctagtctgggccacaccctttgagaaccactctctgaaacaggacttctcagtcatggtgtgagggaaaggggagttgtttggagcatgtgaaaagccttatttatatgccccagttaagcccaattgggatttggactcagcctctttccaggattggcagttgttggcagatgtacaggagtgcttttggcttttctggttaaaagaggtgaaaggtggggctaattcagagtatggagatcagaggggtgaatcatggagcaaaaagggggccttatctgcttcttcatccattctctctgtcatcctggagctcagcttttggggcctgatagggagaaagacgagacagaagctttcagaactgagaagtcagaattcactggctttgttcctcactaataccttgacaactttctccctaaggcagtggatgactcacgtctagctgcatggtctggggggaggagcctcagggtacaagtgacagaattcaatgaagtgcaaagtgggagaaacaggcacttcaaacctcaacgtattaccttgctacaagtgtgcctttaactcactgtttgagtcacagaaggaaacagcatagggcttgctctcagggagccggagtatagcatctgctgatggccagggtcactggaatatttgcctctgtctgggcagagtttagaataacaggcagaggcatagggtgggggctgtgccggaactctgtctatctcatctgtgtacccttttatagatggtcatcggatttgtatttgcatctcagtgtagtcagacattcttccagaacactccagcagtgcttctgtgcctgctggaaaatagctgcagctctctcctgaggcagctcttcccacagtcccagctgctcccctgggatcctccttggacctccccatagcctggcaagtaaacttagcacctgggcatatcagggggcctctaggaccctgttccagtactgagcacagcatcagtactggttagcttgtgcttgggctgtgccatttggaagtattttgaagatgcacatgcacgtgtgtgtgtgtctgtgtgtctacggtggtgaagaatggagggatgtgggatggggcagattcagtagatgccttgagatatggatagtttggtaaaattatgataataagaaaatggaaaggatgccagtttccttccagctagttaagacccattactttactcattgacccacctaacccatccatccatccacccatgcattcatctctccatccatccatccatccatccatccatccatccaatccatacattcatccatctaatccatccatccatccacacatgcattcatctctccatccatccatccatccatccatccatccagttcatacattcatccatacattcattcatctgtctaacccatccatccatccactcagccaactcatccatccatgtaatcatatatccgtttaggataaatgtatccagcactctcttttagtgcttctgtgtgactgaggatgtttgacaatgaaaggaggaagcattcatctgctgggaccccttctaacagatgttttcttctcccttcatccctgaacaacagtaggagaaacaggaaacttgtcttcaaatggtagcccttttccctgactgtctgaggatcatggtctgagaatgtgcctctcagtttttaaaaatccttgaattccatgattcagtgatgtagttaatgtagacagggctcttctatcaaagcagggagcctattgaagatatgagaaaatatgcactgtttctctagagaagggaagtaaacccgccttcctcagagctgggaaggcttttgtcccaagcttctgaaaattaaacccatcacttaacgttctcactgagcagattgcggggcttctggccctatgctgcttgggttgtgcagagctgccgacagacagttttgattgaatgtccaaattaagctgccaagcagcgactctgcagctccagggactccatgttagtatttatgtcacatctttagaaataatcacattgcaaagcagcacccagagccatgtctgcagccgctgcagcgtgggagagggggctgttgagcacctcctgcctccatgcttcatgctgcatttactcagcacccaagcaagggtggggccccatggcacgccatcctggttcctgtcccgaggatatgagtgaggaattggtaaacctcgtctgtccttcttgttttcacttaacttgaggcaggaggtggtctccaaacaagaagtaaagctaacttattggatgcctgactcccaaaccatctgtcctaggcagacagaaagaccctcagggccaacctgaggggaacagatgtttatggggggcaggtttactcttgtttttccaagctgggctgaagagctcctcttccatctgcatcaagccctgaaaactctgccgtgcatgagtaaagtagcaagtgctgcatcccccagtgagatccagtggtgacattgtccacaccactggggaatgctagttattaagagactgggcttgtgagagctcaaaggtggactaacccagatcttccctgtcgagggaaatggtctctagacttgtggggttgtggttgtgtggagtcagagtaagtgtggagcaacgctgggaactgtaggaccctgaatgaccagggaaaccgctgtagaaaatagttgacactaaactgggtttagggggtcataaaacctccaagatttcaaagcttctgggtcccaggaggactcagttactgagcacaaaagttgcatggttttggtgtcaggcctctgagcccaagctaagccatcatatcccctgtgacctgcacgtatacatccagatggcctgaagcaacggaagatccacaaaagaagtgaaaatagccttaactaatgacgttccaccattgtgatttgttcctgccccaccctaactgatacgatatattctcccccgcccttaagaaggtactttgtacacctatcccaaacctataagaactaatgataatcccatcatcctttgctgactctcttttcggactcagcctgcctgcacccaggtgaaataaacagccttgctgctcccacaaagcctgtttggtggtctcttcacacggacacacgtgacatttggcagtgttgcaaaaccctcagaagtccgagtatcagctggactgaaccttggggcacccgcgttgtgtctagttccagtttgttaagaattaggtgcacaagaccagccccccttttacacaatgatttctttctctcagatttagagtaacatttttttttctaactaaaaatgtaattaatgctcaactgagaccatatattgaatgtctccttcttccaaattcccactgaagtgacaaagagattaaaaatggaaaaaaattgatcagggtgacaaaccagaaaaatggtatcaatcagatgccagaatctttggggaatttttctaagatacaattcagacaatccaagctgattttgtgttctcttttccaacatctaagcctcttatacaatacttttaaaaaatgtaattgcgttgattggtactttcagaacaatgttaaattatgatagtgatggtgggcattcttaatttgattgtggccttaatagatatgcctctagagttttacccgtaagcataatgaaggctgttggtatatttattacgtcaagaaaagcattcatttatttctatttttccaagtgttaaaaggacgaatggttattgaattttgtcagtcgcctttttcgtcattttttaagataattatatagtttttctcctttgacctagttttatagtgaatcatattattaatagattttctaaaattatgaaagatttttgtttgaagagtgtgcgatcggtttctagcttttgaaagatcactttggtgggggagtgaaggaagggctcaatagaagaccacaggcaggaaaccaatgaggaggatcttaatttcacccagagaggaaaagtgagtggccagggagcaatcatatgagcagctgctgtttatgaatcactcatcacctgcccagcacaataccaggattcaaatataacttaataatcacagtaattctatggcacacttattattgttcagatggcagtgatatgaatagtagggactcaggtacacaaaatgagaaagaggcagatcaaacagcacggggttgtagattgcaccaaagggaggagaccagaatgatttctagattcttactggggcagttgggtggatagttcaacactcactaagactggcattgaaagacagggaggagacatggtggtgtcgggggagcaggaggataatgagcgttgttggacatgttgagtttagcgtacatatgggacatccagtacaagataaccagtggacagttgtacatacagttgtaaaggtcagtaaagaggtgtgggtgggagttgtcagtatttaggtagaagtaaaatcataagagtagagcccctggaaaaatacggaaactaacaaacaaacttccgaataatccatggtttagttcaaagaagaagtctcaagggaaataagaaaatattttgaattgaaagaaaataaaagtataacacatgatactttgtggaatccagattaaaaagtgcttaaaaggaaatttatattggtaaattctaccaacacttaaagatgaaataatactgattctcctaaaaagtagatgagaagggaacatttttcaacctattttatgaggctagcattaccctcataccaaaaccagacaaaaatagtacaagaaaactacaagcaaatatctcaaatattttcttccagttcgtcatttgtgttttgcagaacaaatgtttttaaactttaataaagtacaatttatcatttttttcttttataggtcatgtttttagtgtcatgtgtaagaactctttgtaaacataaatataaaaatcttcatagaaatattagcaaattaaattcagcaatatataaatgaaaaatacactccgtccaaatgagttttatcctgagaatgcaagctggcttaataataaaaaaaaaaatcaaccaatgtaatttaccatattaataatctaaagaaagaaaaaaaattaacatatcaattgatgcagaaaaaattggacaaaactcaatattcatttatgatgaaagttctcagcacactagaaatagaagggaactttcttgatccaataagaagtatctaccaaaaacctgtaacatacttaatgatgaaaaactgcatgctttctcattaagctatgaaacaaaactaaaatgttcatcctccccagtcctattcaacatcatgtcataaccagcacagtaagataaaaaaaatttttaaaggcatgtggggctcggctcggtggctcatgcctgtaatcccagcactttgggagcctgaggtgggtggatcatctgaggtcaggagttcgagaccaacctggccaacatggtgaaacccccacatctactaaaaatacaaaaattagtcgggcgtggtggcagatgcctgtagtctcacctacttgggagtaggcaggagaattgcttgaacctgggaggcagaggttgcagtgagctgagattgcaccactgcactccagcctgggtgacagagcaagactctgtctcaaaaaagtaataataaaataaaaaataaaaaccatatggaatggaaaggaaaaaaagaaaaattgtttctatacacagaaaacagtattgtttatgtagaaaatccacaggaatctaccaagaaattactagaaataatgagtgagtttagctgggttgcagcatacaagtcaacacacaaaaatcaattgtatttctatatattaacaactagaaaccaaaaatttaaaaaatactacttacagcagctgcaaaacaaaggaaatatttaggtataaatctaacaacacatgtctagaatctatatgctaaaaattccaaaacactgaaagaaatcaaagaatacctaaataaatgaagagataacccatgttcatggattgaaagactcagcagagtgaagatagcaagtcttacgattgatttgtaggcttaatgaaattcaagtcaaaatcccagcaggattttttgtatgtttggacacagtgattctaaaacttgtatagaagggcagtgaatccagaatggccaaaacaattcttaagatgaagaataaagttggaagaattactgtacccaatcttaagacttactatataaagcttcagtaatcaaatgtgatattggtgacaggatagatacacaagccattggaacacagtagagaatccagaaatagacccacacaaatacggcctattgattttcaacaaaagtgcgaaaacaatgaaatggaaaaaggacggtctttcaacaaatgatgttggaatgattagacattcatatgaaaacaaaatgaaccttgacctccatctcacaccttttgcaagaattaactcaaaatgggtcatggagcaaaatataaaggtataaaatttcagaaaacacaggagaaaatctttatgacctgtagttatacaaagagttcttagacgtgacacttaaaaacgtgacccataaaagaaaaaaaaaaaagtggtaaattgtactttattaaagtttaaaaacttttattttgcaagaaacaaactataaactggaagaaaatatttgcaaatcacatatctgacaaaggacttgtatccaactcattgtatcagaactctcagactcatttgtatgaagccagccttacttaaaatgtaatctaaaaacctgaacaaacactttaccaaataatacaaggatggccaatacattcatggaaagatattcaatatcactagaaattacagaaatgcaaattaaaaccacaatgagataccattgcacacttactagaatggctaaaataatgatgataatgataataaatactgtcaatatggtgtgctaatgagtatgcagaacaagaggaactctcattcatcactgtgggaatgcaaaatggtacagctgctccgggaaagtgtggcagcttcttataaagctaaacaaacgcatataactgaatgatcccactcctagttatttatcttaaagaagtgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcggtggttgccaggggctgaggatgagaagaggatgtgactatagaggagaagtatgaggaatttttccgaggtgatagaactcttctgtattctgattgtgtgatggttacgtgaatctatacatgcattaaaatgtataaattttttcacaaaactgtgcaccaaaaagtcaattttactgcatgtaattaaacacataaaataaatgttataggcagaaaataagctgataaaagacacaagtacacacagagagagagaagagagagaaaagaaggcaatagtccaagatgaagagggagatggataagaggaatgcagaagaaagaaggttgtcatgttatgatactaaaaagtaatttaaaacagtagactaaatcaaagtgtgtagaagcagtagatagaggagtgcctactgcagaaaatgtaataagtaatatggaaacaagcttaaggagtgctccaatggggatggcaggggaaagggacaaataaataaatataaccactaaataaatgacagatgtagagaacaaatagcatttatccatgggtaaatgagtatcagatactcctagagaaaagaccagagcaaatggaaaagcatctatactgtattcaaagtagagttcaagacaaatatataatatactatataaaatgtgtcttttatttatggtaagtaaagtctggggacaaaaagtaatcatgaacctagggccaaaatgcataaagcaaaaacttgaaatgaaaggagtaatttacagaaataccataatagaagggctttaaaaacacactttgtcagtcttggacagataaaagcggttaagaaaatggatatagataatttaaataatataattagagtgaatataaaatacctctctatcttgaatcctgaacccttcaataaaagaattacattttttccctagtattcacaaaattagtgatatattaacttgttaaggaaacctcattaaattccctccaaaatgcccccagaaattgctcagcccacattttccgataaaaataaaacagaactagaaattaatgacaaaaacatataataccaaagatcaatggatgagtgagatggaggtaggaatcagatgggagcctcaagaattgaaatcttgaaattgcttctgtaaggaatgggaaattaactagggacacccaataggtttgacaagcagtgtgcgggactttgctgtggttggagatcatgggtatatagtggcatgaagcccctatgtgtgacactttcccctggggacactgtctagagcaaatttcactcatggttgagggtatgcacacaggatgttgaagagacaggaaggtaaggacatttaagccactggtcagaagcgattgaatggcttttccatatgggaagtggtagggaggaagtaaaaccgtagcaatgcactgatggaccaggggaaaggaaacagttgaggaactggagggtttgatgaaatgaaaaaaaaaaaaaagccaggtaaagggagtagagacataaaaggataaactaccactggagagtttagaggctatgccatatcaggtgaaactccaaatgcctggactggagtggagaggaggtcataagaagaatggatgatacgtttgacttcacgtcgtctattattctcagacctcctccaagattcatttgtatgaaaatcacattggagggatactcttttagccctggaatttatcttgattgttacataatttggtctaaattctctgaaaggagaaaggaaatcaacatttgttgagcctctgccatgtgccttacattccactttgacactgttatcctctatcattagggtagtcatataatttattgttaaaatttggactctcttaagagtgagaggacaacagttctaaattgaggttgctctgggaaaactgggatggatggtcacccccactattatccaagagcccatttgagttgtctgtgtaggtttatgagaatttgggggtggggagacaaaggctcagagaagccatttgagtgagatcacccagttagtgagagtcatggcagaggtagaattgacaaccgtgtctgcctgactctgaggtctagccattgctaacttagttcctgattcaccacgctagctctccaccattgtttcactagctgtggcttgacaggctctcttcttgacagacaccatgacagtcccagctggaagtctgtctcaacacagataattagatgtgtgataactgtaccactgccagcaatgatgggaagccagctgttctaggagcctttgggaccacgatgtgctcgggaggactttgatgctggatgtgggctgcccaaagaccccacgtttgctggttttgtaatcagagcctatcaggtgaagattatacagcatggccagttacagaggctgggaaggggattctgagggatttcagggctcataaaagccacagcatcagagaaccttggggtcagaaacccccagggttagaagaagtaataagtaaacaggaatcgatgggacacaaatctagattgtagagcaaagggctaaagaagcttccaacttgggaaggtatggcagggcaggggggttcaagcaaaggaccaggtaaactgtcagccaccaacagataactgaaacaggagaggggcagggcaggacagtgaaaataggttgatggatctgaaatgattgacctgtttagtctctccctccaaccctggttagggcatgtgctgaggatgtccagctgacctcaatgagcttatcctgggtctgtgtgttattcaccacggagctcattttctgggttctatgatgcaaaccaaaagtttttaagtatcaccctgcggatccaattaccctataaactctttggaggaataggatggggtctctgaaagccagggcaatagattcttggaaactgtaaaagcacaactgaatttgtaaattgttttaataacacaattaatacaagaatacattctctttgtcagaaatttaaaatgtgatggataaagctaaaatctttattcacaaccctcaaatcaggttcctctacctgttcctcagaggtggacattattttaaatcaattttgggtatatcttttcagactcttttctatatatttacattcatatatgaccttgtagaaaatgcattttactgtacctttcttttaaatatttggagggcctttaaaatttttttattctgacataatctcaaaatgacagaaaattgcaataacagtaaaagaaatttctgtatacactttacctgatgtactaattgtttatattttgctccatttggtttagcattttctctactaatgtatttttatatgtgtgcacattttttttctgatccatctgagagtaagttggggtcatggtttccacttatcctgaaatacttcagttgtatttcccaagaacaaaaatattcttagtacatttattcaaatgaggaaatgcaacattgacccaatgctattatctgacagttcagctccagatttcactaattgaaccactaatgccttcacgcttctttcttaaacaaagaggcattatattgccctcatcttcttttttcaacgtgcttcatcttgcttttttcaacacgtttctgcatatagataacccaatgttatcggcatgggcaaagtgcgtcacagtatgaatgcgccatatattatttactgtttcccccattggtgggcactcaggttatttcctacttttataattgcacacatcctcaggctgaatattagtgggtattactttggattaatgttcttttatttttccttaataaatccttcactggaatgaattactgttttgaggacacacagtgaggacaaagcaagactcacaatattgaggaaagttccttcaaaaggagttaaataagagatgctcctgattcacataatgtgggatcgggatatgaaagcagcacaattattctgagttttctgacagataattgtatcttcttagaaagaaaaaacaattaaggaacttcttggtgaagaacaattcttggaaaaatagttaacatgcatgctatctttttatggattcagtgctgtcttagagaacttggaccagaatgcagaggcctcgcttgctccaaagacccttagacagaaacaggcagacctcaccctgcacccagagccccatgcccacggcaagcagtgttctctggaccaggacacgcttctcctgtactctttgcaaacttccaccagtggggacgtttgctatttctgctctgtgtgaagcatttggtaccatctgggctggctgagtttcaacaaagatagtaaagaaacatttatcaagaaaaatcaaagtcggtctcgccaagtgtggtctagagagatttgcttccgcgatacatatgcggctctcttgctgctgggaaacacgactcaactttgaaacacttcaggagggacagccctttggatcttagcctgcagctactgtcaactgctcatgatagatggttttagtagccagagctcttggagatgtgaatgccagcagtctcaggatgcattccacagcattccgttgcacagaaagttttggcccctttggtagagaataagctcaaaaggacaaaagtagaagaaaggacctataaaggtgagggaagagtcatgcctcagtgagtaatgtttggctctgcaatgattagattcccaagaaaaggtcattcttggctgcacacagtggctcacacctgtaatcccagcactttgggaggccgaagcgggaggatcactcgtggccaggagtttgacaccagcctgggtaacatagtgagactccatctctacaaaaattttttaaaagttagctggatgtagtggcacatgcctgtagtcccagctattcagggtgctgaggtggtagcatcgcttgatcctgggagatcaaggctgcagtgagccgtgatcgcgccaccgcactccagcgagaccctgtgtcaaaaaaaaaaaaaaaaaaaaaaattgctcttaaaccacgagtcttgagattgacagcttcaaaatacaacactcttgtccagcaaagagcactctaaaagagctgtaaattccttaagcttatgatagaagatctttttccagtgactacccttgtggtgtcagttcataagactggggcggaggagggggagtggccttgccagggagaagaaagatgagctgtttcctcttgcctctgtgttaccaatcaaccagacagacaagcttctggcgcatctgagtgtctcaatcctgtgtgtgtgcagctcactatgtgatagatgtgtcactccaagatcccagcctagaaactggtacatgttattttccttggaaggctcaagaaatgaaagtaacagttggatattatattctatggggaaaatgcatgggtattttgagaaattattattctccagaacaatgttacttaatgtgtgtcttatagactggcagcatcagcatcacatggaaatgttttagaaaagcatatggacaggtttcactgcagacttagggaatcagaatctatctgtgggggtgggtgccagatacatgtgtctcatgagtcctctgagtaatttttatgcacactaaggtttaagaagctctcctgtggaagggttcgagtaaacatcgaatgcattgttaagaagaaaaccacaaatggttccatttgatgtcagtacgtgtggaaatggttaactcttcataataaaaatagacaaacaggcaaggcatggtggctcacacttgtaatcctagcactttgggagaccaaggctagaggatcatttgcatccaggagtttgaaaccagtctgggcaacatagagagacccccacctctacaaaaatttttttaaaaattagttaggcataggttggcaagcacctgtagtcccagctacttggaaggctgagttgggaggatcacttgagcccgggaggtcgaggctgcagtgaaccatgatcatgccactgcactccagcctgggtgacagagtgagaccttgtctctctctctctctctctcacacacacacacacaacaaaaacgtagtgaaagagggcattgcatatgaataagaataataatgaaatagcagtaatatatagcagttaacatttattgagtattttttaagttccaggttctgtgctaaacatgtatattctttatccaattttactcttgtaacaacctattttattgatcaagaaattgaggttcatatgtgtgaagtaactgcttggtaagatgcggaccctgggatcttatagccctgtgtccatgacactatatggtctgtcttggggacaagattaacattttattttgtcccctatatccccagggcctagcagaatgcttagcacttagtagggacttgcttgttgaacttaactgatcaaggtcaacatcttgcttttggtgtaaaaatgagatgcagcttgcaagctgagatgggagatgaattcagcctgtggaaaaatagaagacactgccatgttgctggagtgcagaaaaaatgtcagcacagaataagttacagcttgatcctggtagccgattcaatgcttctcccatctcatttattcggtctcaaccccttactagctgtatcattttagggaagtcagtcttatttattttccagcaatggtcagctgtttgagtgtaggaaaaggacagagtaagaaaggacaggtatttgaatttaagtagggctggggtcatgtgagacaagtaaaataaaaagaaagaggggcaagggagttgagggtctttccaaaggagtagctaaaatgcaccataaaattgaatctggatatgaatggagtaaaagcaagagggaatagggagatcaagagaatgtgttgggttcgagggactgattggtggagaatggactgacgaataggggaagatttattgcagtagaataatagaactaatgaattggaaaaatagaaattggtgtaagatagtagggtacttgaaactgagattgagaaagtggtataatttctgggataataggctccagagcgtgaccatggtaggagataactatgattgggggtgagcaaaggttgcaggaaatgagggggtgctttctctcctactttccaatattctttcttctaatctgtttttcttgttatcttgagtttacaaaatttctggttttatttatgctgtggatatttttccagccttttccctatgggctgtctgggtgcaggttatgggtgatacatggataataggtgcatcttggtttagagggtaactctttatttcttactgcacttatggaacacgagaaaaaaaagtattaaataatggctatggtaatggatatctttgtcttattccttactttaatggaattgcatttatcatgaaccatggtgctgttatttcagatagcctttatcctgttaaaattctctgctgtttctagataactacaatgatcttatggttttcttctttgatctataaatatgatgaatatattgaaaatagatttcctaagattgaaccatctttgcattcctgataggagtcattatgtattcaccttttagcagatagttagagtcgatttggattgaatgtattactgtggattgttctactgtaagtgagatgattgacattgtatccttaagagctgtgcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgacggagtctcactctgtcgcccaggctggagtgcagtggcatgatcttggctcactgcaagctctgcctcctgggttcatgccattctcctgcctgggcctcccaagtaggtgggaccacaggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaaattaacgtaacataaaattaaccattaactgtttttaaacgtacaattcagtgacatttatagaatattcacagtgttggacaaccatcatctctatctagttctcagaaattttcatcacctctaaaagaaaccctgtactcattaagcagtcactccccatttccctttccctccagcctctggcaactattaatagtagtctactttctgtctctatggatttacctgtttgggatgtttcatgtaaatggaatcatacaatatgtgaccttttgtgttggggtacacaaatgttcatagcagcagtattcacaacagccaaaaagtggaaacaacccaactatgcatcaactgctgaatggataaacaaaatgtgggatatctatacaatggaatattattcagtcatgcaaaaaaatgaagtgctgatacatgctataatgtggtgaactttgaaaacgttatgctaaatgaaagaagccagcctttcctgtgggctttgtggaaaataagcttagaaaacttacagttaatcttggtatgggaagagcagtgtaaaagtcagaaatccatttttaaccaacacagaccagagttgacatcttatcagcccatctcattttgtgcactgcttcagctatggatgttaataaaattaaatttctcactaaacaagtgtgatgccaaagaaccttccacaagttctgcagctgtcactgcttggtgcttaaacatgttggacagtattaatgcaaaaactgctttttctttttcagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagattgtaagtggaaatgactgcagtgagcatgggtggtggaggttgggttatgtgccacctgaaatcagggagttcctcctcccttagctcctgtttccttccttccctacctccctccttttctgtcttctccatccctcactcctatctttccctcccttcttttccatctgcaattttgtattgtgagccaagaaaaaaaattagagctatttttttaatagagatgagaatgcctgtggtgtgggggagtgggtaggacaggaaatggtgtgatgtgttgctaagtgaaggcaagttgtgggagaaatgatggggctcagcaaataggggaacataacctacagggtgtggtgacagcctctctagagttgggtttatggatgatgcttggcctgcagccttctgggacatctccaccagcctcccttgagggtcttccctggccagggctccaagaatctgggagtctctttcttgtacatctaggcatcaggagttggttataacagccaattcactgagcatatatgatgtgtgacaaacactgggttaagcgatccgacttcatcggctcattttattcccaatgtagcaatagggcttatagaggttaaagagtatgcccaaagtcccatagcaaatatggggtggagtgggattcagcttctggcagtctgactttagcggtcatacttttttagccaccagctagaagcacagttccttgtcctgtctcctcttccctctctcagggcaaagctgggccccttctcagcctcagtcaaggacatgtctcagaacagacaatttccccaggatttttctccatgcatttcctcagcctcattctcaacccacctgtgtgcagatatacacatgtacacacccaattatgcaattgatatctgtatttcttataggcaataggaattcctgaatatcctgaaccctattaagacataagataacaaaagtagttagaactgttcttgtcatagccagtctaagacctctgcctgtttaagccacaggctgtcaaacagaaaaagctctcactccctggagagctagcctgggatggaaactgaatatgtttctttcagcagcttgtaatctttaaaactttctacctccaggtcttgtcctcttgtacatttattctgcttgagaaattactacaacctccactgatgtcttttctttttctctatgcagtcagctgaaagaatcggacaaagacagaagactgtcagtagagatttgggattgggatttgaccagcaggaatgacttcatgggatctttgtcctttgggatttctgaacttcagaaagccagtgttgatggctggtaagtaagattttgccttgaaagctaccatacagcttgctccatcaaacgcggggtcaagtatgttttcctttttctccaaaaattgaaatactaaaacagagtcccaaagtgaagtctggttgattggatctgccttgcagatatgttttgtttggtccttgtactaaaaacaaaaaagaaagaggccaggcctcgtgtctgacacctgtcatcccagcactctgggaggccgaggcaggtagatcacttgagctcaggagtttaagaccagtctgggcaacatggtgaaaccccatctctatcaaaaacatgaaaaattagctgggcatggtggtgtgtgcctgtagttccagctactcaggaggctgagatgggaggatcacttgaaccctggaggcagaggttgcagtgagcaaggtggtcagagattgagccactgcactccagcctgggtgacagagtgataaaaaagaaagagagagagagagaaggaatgaaggaagggagggaggaaggaaggaaggaaggaaggaaggaaggaaggaaggaaggaaaggaagaaaaagggaaagggaaaggaagaagaaagaaagaagaaagaaagacggaaagcaggaaggaaggaagggaggaagggaaggagggacagaaggagggagggagggaattagttctagtattttaaaaatctggggctagaaggcaacaattgagaacagttgaatagttaatgccccctttagacaggacatggattttctatttgtcaccgtcctcaccactccctattttattacatctgggccaatttactaaactacatgatgagactgtaactgcccagtggcttctttgtgcctgctgcccagacagagccgatttatcaagatgggagaattgcaatagggaaagagttttacacacatagagccagctaaatgggagaacagagtttttttatgactcaaatcagcctccctgaaaatttggaagctagggcttttcaaagatagtttggcaaggagtagggtggctagggaatgggtgctgctgactggttggggatgcagtaataggggtgtgaaaaatggtcctcgtgcactgagtccacttctgggtggggccacaggactagttggcaggtccaggtggggcagtctggttgtcaggaaggcaaaagcctgaaaagacatctcaaaaggccaatctcaagttctacagtagtgatgttatctgtaggagtaacttaggaagttggaagtgttgtgagctctgggataaaggctgataataatccatgtctacatcttagcagaattcaggctcctttcattctcctaacttggcaatatttcattagttttacaaaggcagtttagttttgggaaagggctgtcataatttaaaatatacaacaaatttctttcaaagttaggttggcggtctggtcggggtggagccattggttacgagaaatgcaaaaaaacctgaagagacatctcaaaaggccagtctacaatagtgatcttatctgcgggggtcattgggaaagttgcaaatcttgtgacctctggaataatggctggtaatcctttatgtctacaccttagcagaattcaggctcctctcatcctcctaacctcatggtccctcattagctttatgaaggtagtttagttttgggcaagggctattatcatttaaaatgtacactaggccgggcgcagtggctcacccctgtattcccagcactttgggaggccgaggtgggtggatcacgagatcgggagatcgagaccatcctggccaacatggtgaaaccctgtctgtactaaaaatacaaaaattagttgggtgtgctggcatgtgaggatcacttgaaccagggaggcggaggttgcagtgagccgagatcatgccactgcactccagcctgggtgacagagcaagactccatctcaaaataaaatgaaataaaataaaataaacactaaatttgtcacaaagttaacttggcccgagcccaggaaagcgtaagggcagtttggaggttaaaggcaagctgggggttggttagatcaaatctctttcactgacgtcatcattttctccctgttacaatttctgcaaagacagttccatgactggctccatggacactagagtggcttgtacacttcacctgaaagatatgagcaacccactgtcagatggtgtctgagaagctaccgcttccttgggagtccttagcaagtctggccacagatcatagatgtactggggtgttgttttcatagtcagctgctgtgtctcctttgtcctgaagattttattttgctcccttcctatggcaaaaaaaaaaaaaaatatatatatatatatatatatatatatatatatatatatcctccaatgttaccaacagagaggctgggtaagcccccttggcaactgtttcacagttaactgagtcaaggagtcagaagaaatagcttaacctggcactataactttgggagaagtggcaattgggctgctattacttctttaagataaattgtctcatatctgaattgtctcattcaggaccttttcagcttcaagtgaaagaaaataaaaatcaaactggtttagcgagaaagagatgtgtcctttggaccacacacacatctttcctttccattgttcaccttatgacttccttgtcttggctccatgtttcatcttaggccttttttttttttttttttttttgagacggagtcttgctctgtcacccaggctggagtgcagtggtgtgatctcggctcactgcaacctctgcctcctgggttcaagcaattctcctgcctcagcctcccgagtagctgggactacaggtgcccgccaccacgcccagctaattttttgtaattttagtagagatggggtttcaccatgttagccaggatgatctcgatctcctgaccttgtgatctgcctgccttggcctcccaaagtgctgggattgcaggtgtgagcctccgtgcccagcctatcttaggcttttcttgaaacatatattgagtgtccactaggtgctggtcactagaaacacatggaggtataagacagacatgacttcatggagcttagcttatggcagagggtgggttggggagataaacattgaacaaggaattacgcaaatgacaaatcaatgacaacatgatggaagatgtgaagaagacaggagctgagagttttgaacccaaaagtatctgagacagatttcaatcagtttagaaagtttattttgccaaggttaaggatgtgccagtgacacagactcaggagatcctgatgacatgggcccaaggtggatggggtacaacttgcttttatacattttagggagacgtaagacatcaatcaatacatgtgagatttacattggctcaatctggaaaggcaggacaactaaaagtgggacggggaggtgcttccgggtcataggtagattttacaattttctgattggcaattggttgaatgagctgttatcaatagaaaggaatgtctgggttacataaggagttgtggagaccaaagttttatcatgaagatgaagcctccaggtagcaggcttcagagagactagatggtaattgtttcttatcagacttaaggtctgtgttgatgttaatgctggttggcttttcctgaattccaaaaggaaggggatataatgagacatcgtgtctgactctcccttctcatcatggcctgaaacagtttttcaggttaactttggaatgcccttggctgagagaaggggtccatttacatggctagggggcttagaattttattttggtttacagaatgtaccccaaaagagttgtgttaaagcacaattcacaaatggttaaaaacatagttctcataagatagataatgggcattaatgggcattggccaaagatttccttagctcactaaggagaaaagcagcaggatgaatgaatgattccacagaaggtttgataaactgatgttcgtgtagtcagtagaaaaagatatgctgaaataactttgctcagttaaatataaaactgactgatatacaggacaatagaatcataagctttggggttatctactagaatgaaacaaaaaaaagattttggccaggcatggcggctcacacctgtaatcccaacactttgggaggctgaggcgggcggatcacctgaggtcaggagtttgagacgagcctggccaacatagtgaaaccatgtctctactaaaaatacaaaaattagctgggcatggtggcaggtgcctgtattcccagctactcgggaggctgaggcagaagaatcgcttgaacccaggaggcagaggttgcagtgagctgagatggtgccacggcactccagcctgggcaaagatttcacctcagttttctaaaagttaacatgtatctttgcagactagggaggccatctggggctgacctgatggtgaataataaactaaacaaagtaatattactgtgaggaaagaaatagctaattagaaaatgctctagcatgacattaaaagttcacacggtcatctttttggttttctttttcccccaagctttggatatttttccctaacatgcaaatgacttgactttgcagggtgtacatcagttactcacagtggatgtttcattctcattttaaatcaaacttaaagaggttaaagagaaagaatgcatgatcctcagggggtatcagtgtgacaggaggaaacataataataataattataataacaatagctactactcattgactcttaatagatgccaggctctgggttgagcttttccagatgtcgtggagtcacaattttacacagcactgatcaggtgtgcagaaaaaataaagcttatttcttttctataatggacttagactttctcatgcacttttgtgagctcctggtgaccgaggagaagggactctatatgctgcatgtggtactttctgagcttcactgtttcacttttctgactggtcactgttaacagcaaaacccagctctgtaaaatattttaaagaagtttattctgagtcaatataagtgactgtggcctggggaaacacaaacccaagaagctttgaataagtggtcctgaggtggttagattacagtttggttttacatgttctggggaggcagaagttacaggcaaagacataaatcaatacatggagattatacattggtttgggcccaaaaggcaggatagctttaaatggggcttatgggttataggagattctttaatttgcagttggttagagtaagactttgctaaaacttggagttaacagaaagaaatattttatgttggctgggcgtggtggctcatgcctgcaatcccagcactttgggagaccgaggcaggtggatcatttgaagtcaggagttcgagaccagcctggcccacatggtgaaaccccgtctctactaaaaatgcaaaaaaattagcaagttgtggtggcacatgcctgtaatctcagctactctggaggctgaccaggagaattgcttgacgcaggaggcggaggttgcagtgagctgagatcccgccactacacccagcctgggtgacagagtgagactccatctcaaaaaaaaaaaaaaaaaaagagtgtttaagttgaggatgctgtgcagcaagatggcttgcttatggtgcaacttcacctttgcctggcctggcgttagtcctgtttataatctgatattttattgccacaaagagtctgttttgtcagtcttatgatctctactttaacattcatgtcagtccattgttgtatataaactcccaaagaaaggaggcataacaagacgtgtccaatctcctttctctcatggctgataattctgtttttaaggtttttcttagatcctcttggccgaggagggggtctgttctgtcagtggggggccttaagattttatttttagcctacgttcctaaaccagcgcccactgaagtgggactggtcccacctagctttggggcatcattctggctttgtgctgaagatcctggcctgttgcttctccttgtgagttccctccatgcagcaccctctctgtcccactcataggccactgctgggcctggttcagggaggccaggaacctgcctgagtcctccccctgaggagtcttttctgctccttctgctgctgctggaatgatgttgcctggtgcatggataggtctctggccagcgttccagccgaggaggagggaaacccacctctccccaccacctgtcctttctccttcccaaggttctccaagccccaaagggaggggcttctcctacaatcacccaatgagttcatctagagctgattcactgagacggcaatattttagcagagaaagagtttaataaacacagtgccagccaagctgaaggatgggagtttattactcaaatcagcctcctccaaaattcaaagactagggtttttcaaggacagtttagtggtaagtgggggctagggaatggggaatgctgattggtgggttgagagtgaaatcatagggggtcaaagctgtcttctcatgttgagtcagttcctgggtgaggatcacaagaccaggtaagccagtttcgttgtatggattcccagtctgggttgcaccagctggtccatcagaatgcagggtctggaaaatatttcaaacaccaattttaggtctataatagtgattttatctataggagcaattggggagatcctgaatcttgtgacctctggctacatgtctctggagccagaattctaactttgtggctaatatgttagttttacaaaggcagttttagtccccaagcaaggagatggttagttttgggaaggagctgttatcgtctttgttttaaagttaaacgaatggccaggtgtggtggctcatatctgtaatccccgcactttgggagtgccaaggtgggaggattgcttcagttcgggagttagagaccagcttgggcaacaatgagatcctgtctcaacaaaaaatttagccaggcatggcggcatgcacctgtgctcccagctactcaggagcctgaggtgggaggatcacttgggcccaggaggttgaggctgcaatgagctgtgattgtgtcatcgcactccagcctaggcaatggagaaagaccctgtctcaaagtaaataaagaaacaaatacaaataaaaaatgaagttgaactgaaactaacttcttcccatagttagcttggcctaggcccaggaatggacaaggatagcttggagattagaagcagatggagttagttaggtccgatttcttacactgtcatagcttttctatgtcatatttctcttactgtcataatttttgcaaaagtggtttaactcccacacatgccatatccttcttcctgggctagtgcctgccttgtctactcccctaaggctgagagcagggaagaaaaaaacggcttaagaatagggatagtgtatcaggagtaagcccaaaatattactgcatttacacttagatgatcatttaattctccagttattctaggtttcatcatttccaaggctcagaatagttcagcagtgtgttagggatacacagcttgtaagcaacggtgctgggttcaggtccagatttctatgatgccagagcctaagcatatacaaattccattctgcctcctgatacagggttaggtggaaggctagagggtagacagctgggattttatttcggctttcctgactggatggatgctttgtgacctcaggtgagccacttcacctctctgtactacagctttcacagcagatatgccacccatcagattgattacaacaccccctgtcctccatccaccacttaggatagctgtgaagttgatgacataatagttggaagggaacttttccaaaataaaagccctctgcagatttttgcagataaaagtcctcctcagatttacggccaagacatttgcgatgctgtcttgactgtaaatggaccagatcctagacatttggattcttgcccctgggattctttgaacattatgtgatcttgagcaagtctcacaccctttctgaaactcagattcaccatttagaaggggatgggctccatcagctcttctgttgtgctgtaattgaagaccgtgtggcagaaacagcagatgcagctgtggaagctatcagatgtggtgcaccagccccaggccccctgtctgcctcttggccaactgccctgtatctgttgacaaatccgcctctttgtttctaattttgtttatttatactgtctcctttctttccccttcattttccagaggttcatctgttttatttacttatttattttcttcaaggaattaactctgggatttgtgtatcaattttgtttgttttctccttttctgtaggtttattttgtgtttggctttgactttcagttgaacattttactaatttattttttcttctttcgcctgactctgctctttaaaaataatgaatagcttttttgtttgtttgttttgagacggagttttgctctgatgcccaggctggagtgcagtggcacagtctctgcaggttcaagcgactctcctgactgagcctcttgagtagccaggattacaagtgcctgccaccacacccggctaatttttgtatttttagttgagacaaggtttcaccatgttggccaggctggtctcgaactcctgacctcaggtcatcctctcacttcggcctcccaaagtgttgggattacaggtgtgaaccaccgcacgtggccaaaaataatgaacaagcatttaagggaataaatgtttcctctgagttttgatatgctaacattctggcttttgctacttccttgagggcctgcagttgaggttttagtttcttttctaacatgctttaatttaggcattttttttaacccctagaattagatttttgtttaaatttttaatattaatgttaagttactgttttagtgctttcaagttagagaatatggcctgtgcacttttctttttccctcctgttttctttcctttctttcagcatagcttagtatttgttcaatgttgttaaaagttctgtggacttgcaagaaaaagattatattagctattcgtagagtatacttttttgtggagaaagaataaaccttttttcaacttttattttagattcacgggatacatgtacaaatttgttacctgggtatattgcatgatgctgaggtttggggtatgaatgattccgtcacccaggtactgagcatagtacccaacagttagtttttcaatccttgtcttcccctcccctctcccctctacagttcctagtgtctgttgttgtcatctttatgtccatgagtgtagggtatacatttattcattccaatgtattataaggtccagatcttttttttctgaggcggtgtttcactcttgttgcccaggctggagtgcaacgccgcgatcttggctcaccatagcctccgccttccgggttcaagctattctcctgcctcagcctcctgaatagctgggattacaggcatgtgccaccacgctcagctaattttgtatttttagtagagatggggtttctccatgttggtcaggctggtcatgaactcccgacctcaggtgatccgcccgcctcggcctcccaaagtgctgggattacagatgtgagacaccacgcccagctaaggtccagatcttttataccttcatattgtccttttgtttgcttgagctaaatgtgtagtgtttattaagtttcttcaggcaaaatgattcacaaacattctttttatttctaggggtttttgccttatctgtatatggcaatattattaaccacataactctacaagtcttattatattgacatgaagttatctttgttgcagctaatgcgttttctctataattttactttgttgctggcattcattcattcattcattgaatatacacagtgagcacctgctgtgctgaagagacactaatgagcaaaacagacaagaatccgtggcctcatggagttttctttttagttgaagaaaaataaacaacaattgtaaatgaacaaaaataagtaataaaacatggcatgtttgaggctgataagtgtcatagagaaaagtaaacaagaaatggggacaaggaatcttggggagtggagacattcagattttatagggaactcaggaaagaactcactgaaaaggtaacatagagcaaagatctaaagcaggtgaggagggagctgtgtggatatctagggagaggttgtcttaggcagcgaggacggcaagctcaaaggccctggggcaggagtgcacccggcaagttggaagagcagtaaggagactcctgtagctggagctggatccatgaggggagagtggaggaggattaggtcttggaggatatggggagagggttggcggatcctgtcggccttgtcaggactttgtcttctactctgaagaacacggggagccaaggaattaatgagattgaactgacctttgcatatgtcctctagttgtggtgtggtcgatcccttttccctagtaggtcctttcccattcttttatgtctaatctttctaagtcctttggtcttgtgtaacaagcggcacgttgttggatttttttttttttatttttgagacagagtctcactctatcgcccaggctggagtgcagtggcacgatctcagctcactgcaacctctgcctcctggattcaagtgatttttctgcctcagcctcccgagtagcagggattacaggcatgggccaccacacccatctaatttttgtgtttttagtagaggtgggccttcaccatgttggccaggctggtctcgaactcctgacctcatgatctgcccaccttggcctcccaaagtggtgctggggttacaggcgtgagccaccaagcctggcctttttttcttttttttttaaaattttactttaagctctgggatacatgaacagaaagtgcaggtttgttacataggtatacatatgccaggtggtttgctgcacctatcaacctgtcatctagatttcaagccccgcatgcattaggtatttgtcttaatgctctccctccccttgcccctcaccccctaacaggccccggtgtgtaatgttcccttccttgtgtccatgtgttctcattgttcaacttatgagtgagaacatgcagtgtttggttttctgtttctgtgttagtttgctgagaatgatggtttccagctttatccatgtccctgcaaaggacatgaactcatccttttttatggctgcatagtattccatggtgtatatatgccacattttctttatccagtctatcattgatgggcatttgggttggttccaagtctttgctattgtagctagtgctgcaataaacatacatgtgcatgtgtctttatagtaggatgatttataattctgaatctgaagatcttttttccacaggaaaatgttttaatgtttatagctataattgccatgtttcttatggtgtttctaaagttttctttttctttcctatttcattctttttttttcatctccttctaaacagataactattatcttaaatcagtgttatattacttttttttaaaaaaactttctgttattattaataatcacattttggtcttattacaaaaaaaaagcaaaaaacaaaaaacaaaaaaaactaatgctttggaatcagacttcccgggttagaatttctactgtaccacttcctagctgtgtacccttggcaagttacttcgcctctctgtgctgtgtttcctcatttggagataatagtcgtaattatgtcacaggattgttgcagtatcaaattagttaatataagtgaggtgcccaatgtctgctaaatagcactcagtaagtgttagtcattattgttaattgaataattattagaaaaatataagaaattggagaatttcagagaccccagattcccagtgcccataaccactattgaccctatagagagagagagtgaagcaaaaaatgaaatcttactgtgcatactatttggtaccttgcatttttcacctaaaaataatccgcaataaacataattgtggcaaaacttttgtgcccagctttaataatttcctaataaatttctaagcctggaattgatgactttaagcatatacacattattaaagggtttgccaaaatgtcctacaattttaaaaatcaatttacagtcttatcaatcttgtatgaaacttttcagtttattaacattaacatccagtgctataaatttcaaagatatgatacaaagattatacacatattgtattagaaattatgttgaacattttcatttgcatattgccatttgtttatatttatatatgactatgtccttttgcctttttcttattgacttgtaagaactttttatatgagaagaatattaatatgtctttcctgacatatgtatgttgcaacgttcctcctcctccttttcatgttgtaaattaattttggtaatatgcatttttcttatggtatataaagcattcggttcaactccaatctaatatgatagatatcaagccacttgccagaaacatttctcaagtttttcttttcattgactaattgttatctgaattatccatgctgtgttcactgtctcaaatgaattttttaattcagtgattatatttttcttccgaaagtagtctttcccactctcgtatttgttcccttttcacagatgcaccaacctcttgaatctcactgcaaatatgaattaggtagtttctagaatgttctctcttttggcagcagttgtatttcatgggagttactttgattctgcattgtttctttctatttaaatgactaaatttttcacacatcctattgtgcttatttgcctatccttatagaagggtgagcacagacatttctgtgtccttgttctaacatttcatatctggataaagggagacaggagtcttttgtattttttggaattctgttttgtcagatcaggagtcctgttcctgacatttgggcggggctacagtggagacaggtccataacaggcacccctcaagccagatggagagcccatcttcctcacgttggttctgtgcatctcaaagtcagaaggggtcctgctcctctctgagggggcacacgtgtcctatttggaggcagtagtggcagcgtccttcactcactctgtggcgtactggccaccgtgaacacacgctgtggcaccatgcccctgcccgctgcgccaggcactgacatgtctcctcttgcatatgaatgggaatcggcaaccctcacccggtcattgatggtctcagccggggtcattattgggctctgttggggcaccttttatggatgacagctggtcaattcccctttatctgtattttcccaagtgtgagaccccaaatactctagatggttcacagtcagggcataaataatattgaattgtgccccaagaaagcaattattttgtcagtgttctttcagttcttcaaattatggcaaagagaaaatctcagaggtctctgatatatcgttaacactctaacacttgctcttcgctgatctcccattaaaaaggggcaggggcaggctttcgattgagagcctttagtaagcaacaccatctacttgcacgtgcataaccttgatttccttgatttccatttgtttatttttttttctttttttttttattggaacattaattaggttttattttcactttttgtttccacagtaacatgtatgggattaggttacagtgtttatttgtccccaatcttttatttatttattttttttattatttttttttaattgattgactttttattttttattttatttttttttaaatttatttatttatttatttattttttattgataattcttgggtgtttctcacagagggggatttggcagggtcataggacaatagtggagggaaggtcagcagctaaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggcggccgggcagaggcgcccctcacttcccggatgggggggctggccgggcgggggactgacccccccacctccctcccggacggggcggctggccgggcggggggctgacccccccacctctctcccagatggggcggctggccgggcagaggggctcctcacttcccagtaggggcggccgggcagaggcgcccctcacctcccggacggggcggctggccgggcggggggctgacccccccacctccctccccgacggggcggctggccgggcagaggggctcctcgcttcccagtaggggcggccgggcagaggcgcccctcacctcccggacggggcggctggccgggcggggggctgacccccccacctccctcccggatggggtggctgccgggcggagacgctcctcacttcccagacggggcggctgctaggcggaggggctcctcacttctcagacggggcggccgggcagagatgctcctcacctcccagacggggttgcggccgggcagaggtgctcctcacatcccagacggggcggcggggcagaggcgctccccacatctcagacgatgggcggccgggcagagacgctcctcacttcctagatgtgatggccgcccggcagaggtgctcctcacttcctaggtgggatggcggccgggcggagacgctcctcactttccagactgggcagccaggcagaggggctcctcacatcccagatgatgggtggccaggcagagatgctcctcacttcccagacggggtggcggccgggcagaggctgcaatctcggcactttgggaggccaaggcaggcggctgggaggtggaggttgtagcgagccgagatcacgctactgcactccagcctgggcaccattgagcactgagtgaacgagactccatctgcaatcccggcacctcaggaggccgaggctggtggatcacgtgcggttaggggctggagaccggcctggccaacacagcgaaaccccgtctccaccaaaaccagtcaggcgtggcggcacgagtctgcaatcgcaggcactcggcaggctgagtcaggagagtcaggcagggaggttgcagtgagccgagatggcagcagtacagtccagcttcggctcagcatgagagggagaccgtggaaagagagggagagggagaccgtggggagagggagagggagagggagagggagaggagggagaggagggagaggagggagagggagagggagagggagagggagagagcgtccccaatcttttaagtctattttttttttcttgagacggtgtctcgctctgttgcccaggctggagtgcagtggagcaatctcggttcactgcaacctctgcctcccgggttcaagcgattctcctgtctcagcctcccgaatagctgggactacgggcgcgtgccaccatgcccacctaatttttttgtggttttagtacagatggggtttcaccatgttggccaggttgtctcgatctcctgacctggtgatctgcccaccttggtctaccaaagtactgggattacaggcataagccaccatgcccaaccttttttttttttttttttttttgagagacagggtcttgctttgtcacccaggctggagtgcagtggtgcaataatagctcactgcagccttgaccttctggactcaagcgattctcctacctcagccgctcaagtagctgggactactggcatgcgccaccatacctagctaaatttttttaatttttttgtagagacagggtctcgctatgttgcccaggctgatcttggactcctggcctcaggtgatcctccttcctcagcctctctaagtgctaggatgacagacatgagccaccacgacgacctgtttatctttttgtttgttttgttttgtttgtttttaacaattattttctatttgtaacaagtgatattgaatttccttccaaggaagaaataaaaagtgtcctttaaaattaaatttattattaaaaaagtaaaacagatatttcaacgctgatatacaaatctagcaaaatccacaaaggtagcatctgaatggataaagttaaagtttacccaaaatagctctgttttctttctattactttaatttgtaggaatccctggaagtccctgctgtgtggatagcacccttctcgatttccagcaaagatacagatgctctcttgtttttatatttcttttggtaatttccgtggaattttggaagaaaatttggaatattaaatgtggaggcgtagaggctcaaattgtcttctctgctttgaatcacctagcccatttttggaagctgcgtaagaagattcgtgaatggagagaaaacattgtgatgaaaattttaaactttggttaggaatgatctttgagagcgaggagttttggggtcttttttctttcccactgattcaaatgcttttagaatgtcccttttctttcctcacactcatctcatcctcttactagatgaaaaaatctttgtggtcaagaaacaaactgaagcccccatgtttattattatattagtagtagctgggcatggtgggatgtgcctataatctcagctacttgggatgctgaggcaggaggattgcttgagcccaggagttcaagactggcctgagcaacatagcaagaccctatctctgccagaaaagaaaaaaaagaaaaaaaaaacagccaggtgtggtgggatgtgcttttagtctcagctagttgaaagctgaggccggaggattgtttgagcccaggaggtcaaagctgcagtgagctatgattgtgctgctgcactccagccttggtgacagaacaaggccctgtctctaaaataataataatgacattagtcacagtaataataatcatgatgatgccactaattgaatacttgctgaatgccaagtgctgtgcttatcattttacatgcgtcattacatttcaatttcacaagaattctatgaaaaaggaatttgtattccaatttatagatgagaaaaacagaggcccagagaggctaaccagcctgtctaaggttatgagatgagatttgcacccagacatggtttgactccagggcttgtgcgcttaaccactaagggatgccgtttctcaaaaaggctgactacagcacattttgggaaaacttttgcagagaaaatagcatcatgaagtcaagtccatggtcacctaaatgcagttgagtgccaggatggcaaagtggcaccctatgcaccctatgtagggtgaaaggtagaaatgctggaagagcatgacaagagtgtatttacagtcaggcagtgggggttgcaatttgggaggatagggtgagaagatcacttgaggtcaggaattcaagactagtctgagaaacatagccaactcccatctctacaaaaaaatttttttttgtttaattagctgggcatggtggcacatgcctatagtccccagctactcaggaagctgaggcaggaggatcgcttgaacccaggagctcgaggcttcagtgagctgtgattgcactattgcactccagcctgggtgacagagtgagaccctatctctaaaagcaacaacaacaataacaacaacaacaagaaatttacgatgagggatcttcatagcattctttcagaataagaaactacttaatggacaaaaagtaggtaaaaatatacagtaatttaacgatataactaagaaaactgtgtaagtgtgtatagagagagagtgagaactttgcctcctatgtacatgtgatatacattttttttctgctgtccatggaagagttacaaaaatacatagtgtacctggtagtgtaccatgcacactacccccacccaacatactgaaaaacaaaccaaaacaaaccaaaaaaccctcaacgtatattttttcaagtagagctttatataggcctccttttcatatgctgatcaataaaataataccgagtcgagtcatgaaatgtgtcccacccccttgtctcccttcaggtttaagttactgagccaggaggaaggcgagtacttcaatgtgcctgtgccaccagaaggaagtgaggccaatgaagaactgcggcagaaatttgaggtgaggtttcttttctttttctcttctttcttttttctctttcttttttccttctttcctcctgctccctcctctttctttctctttctctcttattcttttttctctccttccttacttccttcttcctctctcttttctttccttctttctcctttctttctttcttgcttacttgcttgctttctcgctttcttcctttctctcttgctttctcttgcttgctttctcgctttcttcctttctgtcttgctttctttcttgcttgctttctttaccccccttttctttgttttttccttccttccttcctgccttccttcctctctctttctctttccctctcattctttcttttctttctctctctgtccttcctttgtttctttctctctccttccttcttcctttcttccttccttcctttcctcccttccttctttccctccttcctccctccctcccccctttcctttctttcttcctccttcctctctcttttcattctttctcccctttctctctctcttcctctctcttgtctctctcttctttcttcatctcctttctttcatcagtgggaaccagttaggtttgctgctgtgctgattttcctgtttatggcatggtttctactaagacttttcatgactctgagcctttgcaaggttgttttatctcctagaaaactctgattaatccttcaagaccccaattaaatgcccttgccttatgaagttattcctgcttccctgtctgcattcaggcttagacatttcttcaaaagtgctcattcactgcccaccattttgatggtgacttggactggaatggtagtcatggtgaatgaaagaagtagacagagggccgggtgcggtggctcacacctgtaattccagcactttgggaagctgaagcaggcagatcacttgaagtcaggagttggacaccagcctggccaatatggttaaacccagtctctactaaaaatacaaaaaaattagctaggcatggtggtgcacgcctgtaataccagctactcggaaggctgaggcacaagaatttctctgggtggcagaggctgcagtgagccaagattgtgccactgcatgatcagtaatgctctgttgcccaggctgcagtgcaatggtgcgatctcggctcactgcagcctgggcaacagagcgagacttcatctcaaaaaaaaaaaaaataagtagacagagaagtgatatattttggaggctgagtcaactaggcttgctgatggatggaatctggattggctctattgacagaatgatgctatatagttaacgaatggaattgattgtgctaatgacttcatgaaataccctgggggtagatcttcccagagaatagttttatcaaatggaaagcccttggctgtgaccttgagttacattgctggctctgctcctacctgaaataaatccctttccttctacggggacaaataaacaccattttcagctacctaagagcagcaggtgtataggacacatccttgctttacaaagaaaatgtttgggggaagataggtttgaatacttacattatatgtgcattgagtgattttagtagtttcctgaggaaaagcacattattttgttcccacaaactcaatacactgagtctggtgggagatgatcaattctagataaaccatgatggcctactaactccccaaaaatgtatataatagcatagctaaaatgaaattaatttttattattgttattcatcaaataatgacacacacaaataaaaaaaaaacgtgtaaagaccatgtaaagtcctgggaaagagaggtcaggtaccttgagaacatgtacaagagaaatgtcacgtagtttgagagaatggggaggtgtcaggaaggaaacagcaatggaagtttaccatgtaaaaagaggggaaaatgtattctgttctgcaaacagcatgtgcaaaggccctgtggttgggggttatatagcagcaatgtgagactgaaagaagaccagcctgggtagagcagagaaagccaaagagagtccaaggaaaggctgaggaagtaggcatgagtcacagtacgtagggctgtgctggccttgacaaggattttagcatttatcccaagagtatttatcccaaggactttagcatttatcccaagagtatttatcccaaggattttagcatttatcccaagagcatttatccaagagcatttatcccaaaagtatttatcccaatgattttagcatttatccaaagagtatttatcccaaggattttagcatttatcccaagaatatttatcccaaggattttagcatttatcccaagagcatttacccaagagcacttatcccaagcgtatttatcccaaggacttgagcatttatccaaagagtatctatcccaaggattttagcatttatcccaagagcatttatccaagagcatttatcccaaaagtatttatcccgatgattttagcatttatccgaagagtatttatcccaaggatagcatttatcccaagagcatttacccaagagcatttttcccaagactatttatcccaaagattttagcatttatcccaagagcatttacccaagagcatttatcccaaggattttgttttgttttgttttgtttttttgagacagagtctttctctgtcacccaggctggagtgcactggtgagatctcggctcactgcaagctccacctcctgggttcacgccattctcctgcctcagcctcccgagtagctgggactacaggtgcccaccaccacgcctgcctaattttttgtatttttagtagagatggggtttcaccatgttagccaggatggtctcgatctcctgacctcgtgatccgtctgcctcggcctcccaagtgctgggattacaggcgtgatatcccaaggattttagcatttatcccaagagcccagttaccacacgtggtatatttcagtacgtcagagttggttgcctctgtttggttacggggctttgagttctagggctctaaattgcagacatgaaaaggcagccattagtgagtgtattcctgtttctgagggcacatcgtacacagcaagataaaggacaagtttgtttgttgaaagaaacaaactatcaagtttgttctcccctcaacttgatagaaatagcgcttaggggccaggcacggtggctcatgcctataatcccagcactttgggaggctgaggcaggaggattgcttgagcccaggagttcgagaccagcctcagcaacatagcgaccctacctctattattaaaaaatatatatttaaaaaaaaataaaaaaagaaatagcacttacgtattcccaaattccttgtcttgagcctatgcccacccgacatgctggaagatagtgatagttctgacccagtggggtcctcccttcctgggaacaagtggaacagacacattggccttgagcttatcagtcattctccagtgaccttgataacagaggcttgttcccaaagtcttggactcaagcccaagtgaactgaaaaaagaaccttccctccaagtagaactaaaaactggatactgtttgataaaaattaagacaggaaggcagtctttccagagaacactttctgtctctttcccccaacttgctgatgaagtggtatcatttgctgctgttatagaaatgtactattacgggtgaaaaacacaaggccagtattttcttgtatataaccaagtctcagttttgcaaaatgatttttttctgtcctggggcagctggggtgacatttcagaacaccaaggaaaagatttgctacacaaacagagcatttgtctgggccagtaattggcttggaataggagactgttttatccgcatgcaagaaattgtgtccctttctttctagcaagagcctgcaaatgcttgtttatgcctgaattataatcgctgcatactgtacttgttgatttaaaaaaatgtttccaacagaccgaaaattgttctcaggctcacagaggaatttcagttgaccttgaacatgagaaatgtaatccctgggcgataaccaattagcacccggaatgactcagaaattactttcaagcctcttatctggaggaattctgagtgacagtaaaatcgagctgctagaattggggtaatagaatttcatggtagtgtgagcttggcgcagttaccacacgtggtatacttcagaacatcagagctggctgtttgcttagggggctttcagtcgaccgtgggctttggaaaagaagactccattttggatggcgcacagtgggatttctcagagtcttaaaatttatttgtataacaaagtgcttactgtgtgccatttatgattctaagtgctttgcaaatattaactcaggtaatttaatccttacaacaacctagaatggtaggtactattatcacgctattttacttttacaaatgaagaaactgaagcccacagaggtttaagtaactttataaggtcccagagccagtcattgtcctgggtttgggttttcccagaaacagactataaggattcaagtgcaagtactttatttgagaggtgatcctggaagcaccataagttaataaggaagcattgccagaaaaggtgggaaaccaggaaagtaagtattatcaagcagactactgctgtgggcagctagggtttaaccctgctggagaactctcaagtcagcgcggaatgcatgcctcagaatttcccaatcaagggacaggaagctgaggggttatccgtcggctccccttccgttgcaggctaagggctgctcccagggaaatccactcacccgcactttcaatgtgccctgtgcgctgtgcccgctcctataaccagaaaataagctacaggcaaagaatcacaggtgtttgctgttagcagccctaggtgtagagagcagcatgctggtggtgtcttggaggaacaccagcgattgtacctgtgcaatgtagcctaatggttaagtgtgattgcttgagagccagactgcctagatttgaatcccagttctgccacctccttgctgagtggctgtaagcaagttgctttgtctctctgagcttctgattccctacctgtaaaatggggaattatagcacttcttacctcatgaggttatgtgaggattgaatgaggtaatgcgtttagcagagtgtctcacatgtcatacatatccagatgttagatgctagcatcatggtggttgttataattattgtctcccccttcgggataaataaagctcagaacatcctctttctgggctttggaagggctgcttggaggttagggaaaatctacagggactcctagcctacagaggtccctgccccactgctgggtagctgggagtgcctgtagtagttccttgtaggggtggagtggcagaggaatctgcagttttagccaggacaggcattcatcatcgggagtggagcccagagtctggctgccagggcttctccactgtcccctcgtgctgtctggaaggtggcttggctctttgctcagaaatgctatttgctttctctcttagcattgagttctagggctctaaatcgcagacatgaaaaggcaaccattagtgtattcctgtttctgaaagcacatcccacacagcaagataaaggacgagtttaatttgtgcctcaattttaaaatgttcgctctttgatgcagtgtgtgctaggcattgtccccttggaacaatgggatatttcaaaggacaaaggacagggctcctgtcctctgaaggctcactgagtaggggccacaaacccaggtgttttcaggagccaggcaaacaacaagaaggcgaaagagcttggcatcacccagtgttagcagatccccttcttcaaaagaagctggggatctgggttttcatatctccaaattttcaacagttggcaactaattaaatattaaaatgacaacaaactctgtgcagaccagaccaacagggttatcagacttctttttttttttttccagggttattagacttctgatctagattctagaagttaaattaacatgcccatgagaaaagttataaaagcaagctgggagggagggaggaaagaggggtgccagccccagattcagaggagagaagggagtttctagtgctgagggatgaggctgttagctgctccttgaaggacaaggaaaaaatcaacccctcttcccacccccccaaaaaagtccttatctgtccactacgcaaagtcaaatgaagaaatcaggaagtttgaggtccgtgctcacgtttcatggggagtgtgtgctgggacccgcaggtggatgggaaagttcccaggatgggaaatgggaactggggcaggcaggacttggatcttcacagtctggagaatggagactgtgaatcagatgggtcctgagccaggattcaaagaaggcaggacacatggtgctaaggtgatggggcagcagggaggggagtagggaaagtgtttgggtcaggccagcttgggggtgatgatttaggagggtgtgaggacatagcccgagaaaggtgagacggcttctgtcctaccctggctcttttgtttgcagtttccattgcaaataagatgaccttgtagttttaactaccccctcgttgcctctacaccccaaatctctgtctccagtccagatatctttgctcaagccccaaacccatgtatacaactgcttactgggtatttacacttgggttaaacctcaacatatcttactgcaaagtaaactgaccaagtatattcacagcagcgttgttagtaggccgaaaggggaaacaactcaaatgcctgtacacaggagacgggataaacatcaacaatgagtgccattcagcaatacaaagagacaaattaccgatttatgcaaaaacatggatgcatttcaagaacattttgatgagtgaaagaagccaggcacaagagtacacactctacaatgctgttcagatgaaattcaagaacagacaaaactgacctatgggatagaaactggaacagagattgccttagtggcgggggttgcggggggcgtcgactgggaacttttggagggtgatggaaatgttccgcgtcttgtttggggtttgggttacatgggtgtgcacatttgtcaaaatctacagaactgtgcacgtgagattggtgcactttgcggtgcccacctcaagtttcaaaacatgaataaagagaaaatggcggatgctttgttagccatggttcctatatggtaacagtggaatatgcaccccatgagggagaaataaaccttgaagttttaagctgctgtggggaagaggggatctcaacatgcctgaaatcacaccggtcatctctgcccaccctcttccccacacttccaaacttgctcctcctccgcttcttctcatctcagtggaaacaaccagcatcctgccagttggtcagaacagaggctggggagctgtccttcatctccaatctcccttctcccttgcccaatctgctacccatctggggtcagtctgtctcccaaatagatccactttgttcagtctacactgcagacaactgagtccatcatttttttttcttttaagacagggtctccctttatcactcaggctggagtgcagtggtgcaatcatggctcactgcaacctccaactcctgggctcaggggatcctcccacctcagcctcccgcgtagctgggactacaggcacacaccaccatgcctggctcatcatttctctccttgataatgcagtgacttcctagtgatcactcagcccacgtgctggggggtctcctctccactcagagtgacctgttaaatatgtatggtcataccatagccctgcttcaaacctttcaaaggctgtctgtcatgctcatagtcagcctgaatttcttaaggtcctttcaacactttgtctgcctcctgtgccatatctgccttgcatttcatgatccagccagacgatgtttcattccttgaatgtgtcttcccctctgttccataaatgctgttcctgctgccaataccagtttatctacttcagcaaccccaacataccttttggacacagtatggaggacccaatcccagctagaatgcacgttttttcagagtatctgtatccattttgccctctgatgtatcctcagcacctagaggagcacttagcatgtagcaggtactcaacaagaatttttgatttgtttgttggtttgtttatgacagagtcttgctctgttgcccagactggagtgcaatacagtgatcagagcttactgcagcttccaactcctgggcttaagggattctcctgccttaagcctcccaagtagctgggactacaggcccactgccaccatgtccagctaattaaactttttttttgagatagggtctggctgtgttgcccaggctggtcttgaactcctggcctcaagcagtcctgcctcagccttccaaagctttgtgattacaggcatcagccaccacatccagcctcaataaatgttttttgaatgaatgaatgaatcttccctgatattcaaaactttggaaagatttattttgcctctttatcttcaaagcaaccaaataatgcaacaataataatagctaccattcactgagcatgtgttgtgtgccaggaatgatactaaggactctgtgatacatcatttcatgtcatcatctccatgtcttgaaaaggtgatgaatgtttaggaagcttcaatcaccaaatgcaaattaagtgccttctctgtgccatactcctctaggtaccagggaaacagtggaaagcaaaacagacaaaatccttgccattggggagcttacattctggtataaggagaaagatgataaattgggaaacaagtaaatatatggtttgtaagatggtgacaagtgttttagagaaaatcaagtaagtaaggcggatggagattgctgagagcaattttatgtagggtgttcagggaagagccctcttatcagaggtgagagagttctggggaaagagtgctctgagcagagggaacagcaggtgcaaaggccctggggtaagagcatgtttggtgcattcagagagcagcaaggaggccagtgcggaagtagaaaggaggctgaaatcagaggggctcagtcatctgtggcctttggcttttactttgagaataatgggatggtatatatattgggcagaggaatgttatgacttaactgatgtattctgggccacacagctgattcatgtcagaggattctaccacgaggctttttttttttttttttttagtgagagagagatgggatctcactctgtcacccaggctggtgggcagtggtgtgattatagctcacagcagcctctaactcctgggctaaagcagtcctcccaccttggcctcccaggtagctgggatgacaggtgcacaccaccttgcctggctaactttctttatttttgtagagacagggtcttgttatgttgcccaggctgttctcaaacttctatcctcaatcgaatctcctgtctcagcatcaaaaagtgttggaattgcaggtgtgagccactgtgcccagccacacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacgtggccctcactcatccatttatgcaacaaatatttagttgggaactatactagttgtcaggaaaaccatggagaatgagaaatattccgtgtccacaacagtctccaatttattggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagtagcagcagcaggtgcaaaggccctgtggttggaggggcctgggacatccaggggagtgaaaggagaatgaagctacattgcagagaagaagcaccctagcaatgatggagctggaaagccaggtagggcctaaacacacaagtccatgaaagcacctcgatctttaccctgaaaatgatgggatgccactgagacattttaagcaggaggggacttggttggatgagaggctcactgtggttgtgtgtgaaacccagtgtaagggaaatcactgtgccttgtgcaggtgagagatgatggcaggtagtgatggttgagatggaaagaagtagatgaattctagagacagctgggaggaaagaaatgacagttctggttatggttgagacatgagggataaaagaaagatggagttgcaaaggatgtccgacaggtttcaggcttgtggagtgatgcatggctatgcttttcatggggacagggtgccggagctgcaggaactacagcttcccattgtgtgcctgtgccttcctacaagatcgtcctcaaaccctgagcatgttttctgtgtgcttcctttttgcagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtatggtatgatttggtggctccacctgctttggaaggaacatctaacaacacaggcacatttgctgttcctatgggacggacgtcctagtgggagagagagtaagaagtaaatagagccacactacactttgtaatgaataccatgaaggaaatgaatggagtgctgtgtcacaaacaaaaaggcgaccctttcagtctgaggaggtgacacatatactgagacctggatgatgagaaagaactagctatgctttcaaagagctaggaaagaatgttctcagaagagagcaagtgcaaaagttccaaggtggggacaggctgggtgcatcctaggaaccatcagaaggtgttggggcaaaatgtcactagcagaaggaggtataggacgtgatgttgcagagataagcagggcccaaggatgcaaaccttataagctacaatgaggagtttgggtttcactcacagtgcagcggggagccattgaacctttttaagcagattagtgacacgatcggatttgccttttggaaaagatcactctgacagccaagaatggaaacggttcctttcaaacagttgcacagtggaaggatgaccctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtattcccactgttcctggccaccgccccccacagccatgtacaatgcattggcgaattctgacagttccttcaaagtatatcatgtattcactaacttctcttcatctctctaataccacccaaatctaatcattaatatcacctggataactgcagaaactcctcagtggtttctcaatcccaatcttgttacctataattaatcccaatcccaatcttttttacctataattaatcgttacctataattaattgcaatcccaatcttgttacctataattaatcgttacctataattaattgcaatcccaatcttgttacctataattaatttactttctacttcgtagccgtaataattttttaaagcttacattaggtcaaggggctcccctgcttaagaccctccaatgactttccatccaattagaagcaattctatgttacatccttagcttgtatcaccctttatcatctggcccttgttctctgtgtgacttcctttcttctttctcctccccatcacccactgtgctctggccacaacatcagctcttgggtcactgaaacacacaaagctccttcctcccttagaggctttgtgattcagctccttttgctgtttgcaaggccggctgcttcctgcaattcacatctcaacttagacgccacttcttctgaaaaatcttccccaactacccactgaaaagttgccgctcattcactgtccattatgtttaactctctcatggcacccatcactgagcaatgcttttcttgtgtccttgttgattttttctctcttccctttctaaggtctaagctccacaagagtagggatcttctccgtcgtggtcgccactgtgatttcagagcctagggatggaattcattcagtgcccagattgaatgcgtggattctctctgtctgtgggtggcaagggcatccactgagatggactaagggatctgaaatgatggctcaaagtctgaagagcttcagcatgggatgggaatagagagtaagggcagccagtaagatggcccatccagtccctaaggttgggaataggcagttggcagtggtccacaacgttgtatggtttttaccagcagctctgagtatccctggggtggagatggagaaggagatggtggatttgaactaagcgtgggattagtagaatcagtgaactagaagattatggaagaaagagagttaaggattctgggaagagagatgtccactgcagatccacagagcctgtaccaagtgctcaagaaaagcatgttgaatacatgaatgaaaatggtatctagattgggttggggaagatgtctagcataaagagggtcatcacctgggtgggaaaaagggagtttagaagtctaaggatgaaaaaaaaatagatgaggtcaagatacgtaaaatgttaggaagaattgaggcattgagatttcaaacatggagcagtttctctgatgatgaggaagaaagtggcctaaataaagaagaggttctaataagctgagtttttacaaattaaatgagcactttttttttctttttgagatagagtctcactctcttgtccaggctggaatgtagtggtgcattacggttcactgcagcctcgacatgctggactcaagcagtccagctcctacccaagttcacatctttctctgacccccaaataactgcatgcaccaccatgcctggctaatttttgtttttgtttttttgaatcagaatcttactctgttgcccaggctggagtgcaatggcgccatctcggctcactgcaacctctacctccagggttcaagtgattctcctgcctcagtctcgcgctcggctaatttttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtacttataagctcaagcaatcatcctgccgtggcctcagaaagtgctaggattacaggtgtgagccaccgcacctgtcctaaattatatatatatatgctttcttttttccttttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcctgacctcaggtgatctgcctgcctcagcctcccaaagtgctgggattacaggtgtgagccaccacgcccggccatgatattcttaataagcaatgcattcacatgattcatcattaagattatattaaaaggataaacactgagaagtcctgctcctacccaagttcacgtctttctctgaccacttactgctactgctttccctatgtgaacacttttattcagttaatttgcgtctttccagtccccctgagctaatttaacattttttattcttgtccttattaactcaaaagttcatgtactacgcctgtttttgatcacttaacaaaacagacgagaggatgtttgatggaggattggaagttctggagagtcccatggaaaggattggggttggggggtagtgggtggagtcgtaggagaatgaatcactggggagcaatgagagaatagatcatatgtctccatggaaactgttataataattgagaactctgttccagactggagatatagcatcagataaatcatagatgaaaacaacagtaagtcatgaaagcaaagtagaataacaaacacctctatgatcctttaaaacagagtaatcctttgcaactctagtgttgccaactagggttgtaaattaatgcaggttttatatttgaattccaactttgaacattttgcagtctggttaggtatatagatcaatctccataaacagaagaacacagctgcagtgatttgctcttccccttcgaaagatgaaagtgatggggctttggggtaatctgtttccacctcccttaacccaggaaaacaaaacaaaacaaaacaaaacatgtttttaaaccctaatggccaggtgcggtggtttgcgcctgtaatcccagcactttgggaggccaaggtgggcagatcacaaagtcaggagttcgaggccagcctggccaatatggtgaaaccctgtctctactaaaaatacaaaaattagccgggcatggtggcaggcgcctgtattcccagctactcaggaggctgaggcaggagaatcgcttgaaccgaggaggcggaggttgcagtgagccgagatcgtgccactgcactccagcctgggtgacagagcaagacactgtctcaaacaacaacaacaacaacagccccactaataatttgtggggcaactagggaatggcacaagccttttggtaagccctgtaaaaatgaaacaaggcaggaagcaatggtgaaggacattgaatttcaaatgtgtaagcccgtttcaaaatctttcaaaagaagaaaactgtggagagtttgtttttttaaacaggcagaagtgtttacctggaagggctatcttaccaaagcagggcctgttggcatggctggcttactcggaggtagatgccttctaggacttttaatacagagcattcaaacgtgtcattcacgtttaaaaattattttatttctcaacttttattttagatacagagggtacatgcgcaggtttgtcacatgggtatattgtacccaggtagtgagcatagtacccaataggtggtttttcatttagtgcttaatggtgcttagaattttatccttaactgtctgtttttataatgccttgaaactttgagttttgccaacgtctttcaagaattgaactttgaatgattgctggagtcaaaattatgctgcatatatataaattgggcagatttgtaccgtccggattgatgatacaagcttaccttataaagtaaatacagcaaatacttgatcaagtatatacacagcacaaggataactctttatattataaacgtgattcctctaaccctaatgtgctgccataataaacatgcattaaatatttaatgaatgctaatactgtgtgtcttctgagatttcatatgtgctcatggtaatgatttgtatgatccacgtctttaaaaaatagtatgcaggaaagtttgaatggaggctttcttgttctcttatacccctgactcttgcctatggatggaactgagctaatgtacgtgagttgagatgggatcagggggttagaaaggagctgggggaggcagctggtgtgctatagtggacatagatctataaccataaagaagctgaaagaagcttcagcacagaagatctatgtaaaaatggtatttactggaaaacagaaatagcccaaatggtatattcataataaatacaaaaaaaaacgaagtgactctctcctctctctttctgtccctctctcatgcacgtgcatctatctatctatctatctatctatccatctgtctatctaatctatcatctatctacctatcatctttctgttatctatctacccatcatctatctatcatctatcatctatatctatcatctgtttatcatctatcatctatttacctattatctgtctatcttattatctatcatctgtctacgtatcatcaatcaatcaatcatctatctgtcgtcatagaaagattttcataacatatcaaataaaaataaaagcaaattatggaacattatgattggcaatataaaatgtgtatagaccaattccttttatgtaatatactcatggtccctgctttcattaaactttttcttcaacatttcattatgaaaatttaaaaaatggaaaagttgaaatgattgcataatgaacatctataacacccaccacctggattccacaagtaacatttgactgtatttgctttatcatgtatccatctgtctatccgtccatcaacgcttttttaatgcatttcaaagcaagttgcagacatccatacactttacatttgcagataactgcaaatgcactttacattcagcatgtataccatttaaccagaattcaatatttgcaatgattattttaaaggtaaaattacacacactgaaatgcagctatcttaagtatatcattctatgagttttgaaaaacgcatagtttttaaaatgcagtggaggtatacacattcatttaaaaaatcacacaggcatgaaagcaactgtgatgtttagtatgttccatgggcacctgcgggagtgggatttgccctggttgaagccagagaagtcttctgtgagaaagtggctcgagctatagctaaaggacgagttaagttaactatgcaaagaggggaaatagtaaatgaaaatctcagaatgtctctttgttcctggcccccacccccaaaataggcttggttaatctgtgtggctgacagggcacctaaacttttattagggtagattcatctgctgtaacaaatagacccccaaatatatactggctcagacacaatagaagtttaaaattttcattaaacttctaagtttaagacgtttaagacaggcgcgcctggccacacccactctctccatatggtgattggggacaaggtgtctttcgtcctgtatggctccattaatccctagagctttgtttttctctgcagtcagagggtggaggaggcacaagctgcttcttaaaagtctcagcttgggaagtggcaccaatcatttctgcctactctctattagagaaaatatagccacgtggccacacttcagtgcaaaggaggccgggagaacaatttgggtggatgacacgtcgtctcagccacattccctacttttcagtcctggctgcaatttttcacggtgacacacaaaagaccttctgacttttccctttagagctcttgatgtatcacactccacacacaaaaaacttcaagtgcctcttttctgtgacatttctttgtgttcaaatcatggagcacgccaggtgttagtggtgactttcttgaagctagcacgagccaggaataagtcaagtaggaagaagtcagcagcttatgaaattaaaaagaaaaagtgaagttactatagaaactaggtgcccaggtatcacattttttctcttttaaaaatcccatccagctctgttgctgtctatgaatctaagatgatctaaaatcagaagcagagaggtgagagacagaaccattaagcttccccatctagtgcttgacttccctaaaataatcccaggacactgaaccaatgacattaaatgcctgggtgtatcactaaggaggctgtggagggtctggtggtggccccttccactagggtacccctagaaacttggcatttgtgtgacactctccaagatgctggcatcaacttttgtagctcaaaattcagaccgtacaacagagttgactatagtcttggccaagttttccaaatattagtcatttatgcacctgttatgggtttttccttgccattacatgcctcctttattcgatcatatttttctttaaagtgactttaacttgacttccttttcttcttcttaacattgccctaagcaataatatatgtgaaatcacaagtttgatgtaccagttatacatttattttaatgtgtttggtttgatataccagttatatatttattttaatgtgttttaggaaaatatattaaaagaagagtaattttgttcttgtactagtacctgaaccacatttggtgaaaaactgtcataaaatcttacacttacacaatgtaagattgaggtgatttggcagctcgattaccatggtatttctaagaatgtaaagtcttttgttacaattcgtgtgcgtacctggaagttacaaaaagtctctgttcatccccctcctccatatcctttccttcaaataaggaatatgcgcaacactgcctgtatccttaaaaatctttcgtgtgatcttgacctccctctaccctcctttactcactaaatatatccagacagcaaagctactctttggagattttctaccttcatttcctccccacccactccttccttatccttttgtattatgtctcctccccttagcaactttcagaaacatctgtctcccaggttatcagcagtcttgtaactcatatctctccagatctgagcatgaggcatcctggcttgctcaggggagtagggcaggcatgaggggaagggaactggaaataagattggaatccatacattattctgggcagaagtcatcacctttacagtaacttcccactgaaaggcataactaaggattcattcattcaagaagtatttattgagcatctactatatgccaggtacccttgtaggtacagaggcaatgtctatgaacaaaacaaacaaatatatctgcctgccctcatgaaacttatattctagtggtagtgatggtgacgacgaagatgatgataacacctaacattttttgggtccttactatgtgccaggctctgttataagtgcttagtatgtattcattagctcacacttactctatgatgcagctactgttgtccccattttacagatgaggagagtgagatgcagaaagttggaataacttgctgaagtcacacagctagtaaatggcattaaacagatcagctttgatttagatgtgtatgatttggggctttttttttttttttttttttcttctagagacagggtctcactctgtcacccaggctggagggcagtggtgcaatcatagctcactgcagccacgaactccttggctcaagtgatctgcctgcctcagcctcccaaagtgctggcattacaggcatgagccactgtgaccagctgattttgggatcttgattgcttgaaacttaacatgtaatttcctagttttaacagcgattccgtggaatgtcacaaacatattctaggaggttagtcatttttccctcttattttctcatctttccctctaagtgctaagcagagtttatggccaggtgcagtggctcacacctttaatctcagtgctttgggaggccaaggcaggaggatcacttgaacccaggagatggagcaacaaagggagaccccatctctataaaagcaaaaaacaaaaaaaaattgcatgccttattttcagtgtaagttgctgccattagacaaaccacatactcctagtgatggagggctctgggttttctgttcatcctcatcactctgtgcttattggctacctgtccatgtgtaaataacacatgtgccctgtgctcattggaaccgtgagtcatccgcagggattcctaagagggcccatgagaatggctttcactcctccagcctctgcccttctgacctcctccacaggcttcagccttatgggagtccccaagtcttggaagcatctctagtgagtgcagtgactccttagctggttccttttcaaccttcaacctccattttcttaacccttaccaactctactgcccagctgcacccactccaattccactcacaccctgcccattatcgccaacgtttctgagctcatgctcattgacaaggaccatgccatggatttgcatgcattatatcatattaattcacaccataatcctgcaaggtagtcactgataatcactctattatatcatatagaaattgtaaggcagagaggttaagtgacttctccaagaaggaggcgggaccttgaaagctggttttgtgatttcagttgcctcttgccatctcttctccactttggggtccacacatcttcccaaacccctagtttaaattttttttttttttttgacaagagtctcactctgtcacccaggctggagtgcagtgacgtgaccatggttcgctgcagcttcaacctcccaggctcaagcaatcctcccatctcagtctcccaagtagctgggactacaggcacatgccaccacacccagctaatttttttattgtttttgtagagacagggtcccactttgttgcccaggctggtctcgaactcctgggctcagggaatcctcctgccttgacctctcaaagtgctaggattataggagtgaaccaccatgcccagtccaaaccactactctttcctcttccttttttcctttctttcttccttccttccctttctctctttttgacttttttgaaacagcagttacaaaacgattacaagagctacctaatgaggccaggtgtggtggctcatggctataatcccagagcctctagaggccaagcctggaggattgcttgagctcaggagttcaagaccagcccagcctgagcaacatagcaagacctgatctctaaaaatgtgtttaaaaattagccagacacagctggatgcagtgggtcatacctgtaattgcagcactttgggaggctgaggcaggcagatcacgaggtcaggagtttgagaccagcctggccaacatagtgaaaccccatctctactaaaaatacaaataaaaattagccgggcgtggtggcgcatgcctgtaatcccagctactcaagaggctgaggcaggagaatcacctgaacctgggagtcagaggttgcagtgagtcgagatcatgtcactgcactccagcctgggcgacagagcgagactccgtctcaaaggaaaaaaaaaaaagccagacacactggcacacagttgtagtcctagctactctggaggctggggcaggaagagaggttgagcccaggagttcgaggctgaagtggctatgattacaccattgcactccagcctggacagcagagggacaccctgtctcttatatatttagaaagctgcataatgacatttgtgggtttctccttcttccatgaaaaaaaaagcaaaaaatggtatctcatgactgcattggtatgaagacaaatatattaatattacatattaaaacatgtacttccacctaggttcacttttttccttgtgatttaaaaaaaaaaattaaagtgccttatgaaccttgaaaacagcatgggccctgagcactgtgcctggtgggttttgatggagaagtcagccctatgttccagctccagcatctcaatagcacctccctctgcagcctccaaacttttcttcccaaaggccagggtgcttaactaccatgctctgtgagcatgagagagcattccagagttccaggccccagacctcagtgtcccttttttttttttttttttttcctttttgagacagagtcttgctctgttgcccaggctggagtgcagtggggtgatcttgagtcactgcacctcccaggttcaagcaattctcctgcctcagcctcccgagtggctgggattacaaacgcctgccaccacgcccaagtaatttttatgtttttaatagagacagggtttcaccatgttggccaggctggtctcgaactcctggcctcaagtgatccgcctgcctcagcctcccaaagtgatgggattacaggcttgagccaccacacctggcctcacagcatcatctgctggagccaagcccggcaccagattttaacaggaagaaattgcctgaggagattaaaaggcagcttagttcatgccaggaacaaaggccttctctaaagtctgagcttctgttgtgggagtctctactaattttaatctcattagtggtatgtattcacacacagacatatacatacatacattagatgtggttatataatcctacagacaaaagcacttccctgtacttcagcctgctttgctatcttcctgcaccatatggtgagttcctttatcatatggttcacagatagctcaaagtgtttgctacctgtttccttaatcctcttccagagaacctttttgacatttgctgtctgatcttggattcctgccttctctttggttctatcgcaattatgtcacttccctgcccccaccaagccttcaacctttccttctttcatatgcaattctgattgcagcgtgtttttttttttttttttgccaactcatcttcccagatcctcgtgaggcccttcttccaccttcccgaattttccaggtctctcctcaatgaagtgacttactgctcttccgcagcctctgccttcaattctcagaaggtagtatgttacaagacaagataaggttcatttttctcaagaaaataaattatatcaaggaaaatgaaatgtcaggaatttaagttttacaaccttccatctgctgcaagtagattgtcaagccagagtgagtaaagcgggtatttgctgagaagacatggcttgtttctgtgtatctcaagacacccagaggcaagaagtgccacctgaatgagagagcttccagcagtctgataaccatggctccatctggggggttgtaggggggcccccagcctgtcatccctgcttctcgatgacatctctctgcagatacgcatcagcaccacctctctcagccttgttgatgcttctcaagtctccatgtctaattctcacatgtagaatatcctaggaatctaaaatcccgggaaagaaaaactgatgggccagtgtggaccagggatccctaggatccaattcactgtgaccggggaagcggttacttttccaaccatccatcaggaaagatgacaagaaaagcaaataggatgtgggcagttttcctatgagaaagaagaaaacgacgggcctgtctggcacacaggccaaagtgggagtttcctttaaatgtgtattattttttattttaatttttttattttgtttatttatttatttttgagatggagtctcactctgtcgcccaggctggattgcagtagcatgatctcggctcactgcaacctccacctcctgggttcaagcgattctccttcctcagcttcccgagtagctgggattatatgcgcatgccaccatgcccggctaattttttttttttttttgtatttttagtagagacggggtttcaccatgttggccaggctagtcttgaactcctgacctcaaatgatccatctgccttggcctcccaaagtgctgggattacaggtgtgagccactgtgcctggccttttattttaattttttagagacagcatctggctttgttgcctaggctggagtgcagtggcatgatcttagctcactgcagccccgaactcctgggctcaagcgatcctcctgcctcagcctcccgactagctgggactacaagtgcatgccatcgtgcctggctcatttttgttttttttctagagatgggatctcattatgtagaccaggctggtcttaaacttctggccaccagcgatcctcctgcctcagcctcccaaagcagtgggattacaagtgtgagtcacgtcgctgggccctgtgttttctctaaaatgttgcctgattctttgggaaaaatatcgcaaagataaatcaagtcctcttgtagaaggaccagatagagcccattaacatggaaactctgtctcaggtgatcattcatggctactggtccaattattgtgctatcatggtacctgccatcctctgcatatccatctcaactttatctctatgtattatttcagaaatttacagtcctggtaaaatgaatccctggttactaacagcataacccataatcttttctataatacaacaaacataatggcagaaatttgtggattgtaatcatccaacacccatgataaatattttggatgtacaaatgtggatggtacctatgattattcatgccgtagttgtttcaaacccccaccccaccccacagtttcaccttatgtactgacctcattgaacaccactgcggagattgataacatttttggagcactgggaactcatctgagtgttttataggcattgctcatttaatcttcaccatgggtcttgtgaagtgggtgctgttattatctgcatttttaaatctgtagataaagagacagagtctctattttgcagatgagggaatagaggctcagagaggtgagaagcttgcagtcctgaagcggtggaggcaggttcaaaccagggagcctggctgcagaatgtgttgccactcagctccatagtccccttgcatccagtgccccctactcctgctgtgctgaaacccgttctctattagcagtgctctgtaactccaacaacaaaggggggcagtgcttacaaggcagatcagattataaacaagctttcttcctgccacctaattgttgccatgaatgacaggactttaagggtttcatttcattctctttcagtagaagccatcaattattagtttattttcccagcaaccatttaaaaaagagtcaaattaaatctgcttttattttaactatccagctttgtcaaatataacataggattcaaagaaatttgactaagccatatatgtcaccaatgtttattttatttatgtatttttttttggcatttctgttcttttgtgagtgtgagtggtgagaacacttgggatctcctcccttagcatatttcaagtatataacacagtattattaactgaattaccatgccataccttttaaattgctagtacttatttatcttgtaactgaaagtttgtaccctttaatcaacatctccccattttctctactcccagcccctagcaaccaccattctgctctctgtttctttaagtttgactattttagattccacatatgtgagatcatacagtatttgtctttttttttttttttttttttttttgagacacagtcttgctctgtctcccaggctagagtgcaatggcacaatctcggctcactgcaacctcacctcccaggctcaagcgattcttctgcctcagcctcctgagtagctgagattacaggcatgcaccactatgcccggctaaattttatatttttagtagagacagggtttcaccatgttgaccaggctggtctcaaacccctgacctgaggtgatccacctgtctcagcctccccaagtgctgggattacaggcgtgagccaccgtgcctggccccagtatttgtcttttggtgtctggcttattttgcttaggataaggataaggtgctccaagttcatgaacatttatttcagctcaaaagaaccgttcagttactggaattgatcaatatcaattctattggtaaaaatcaattctactggtatcaacaattagacgacacagcccagagtgtgaaaatagtagttctctcgcatttcttgttacaacccaattagacatttcttattagacccaaccacacatcctcatttaaataccagggccaggtatttcaggtttcaatctccttgttccactcctcccctttctagcagtcactgtgagtcatcccttctaggggtgtagtgacatttgcttaacaatagcaagtccacagaaaccagagatgactgggctaaatgcaccttcattctaaacttcgtttcacactttcatggctttctcagctagtgggcaaaaatgctacttgattaaattacaggtgtggcatggcctcattttaaaaggttgaaatcttaatgcaacctgtcaatctgacctctgaaatgaaaaattagcttatctatcacacagatccatgcttttatcatctataaagagatttttaaatacagaaaaccttacgtaataaatcaagaaatagccaagttgtatcatccgagttgatctatacgccggatatcactgctcttcttttcatctggccaacgtgaagactgtattcgaaaagtgctgcagtcctacctacatccacactattaattcccaagcatcttctccccattatatcactttccagtttttcctgaggtacgtcttcacttggcagagtctacccagttgccttctcctaaacagactgttagaagtctgaaatcatttttagactgctggcttcctctttactgctagaggcaagtgcatttgattccttcaaaccacatgacttcgcatcagactgatgtggccactgtcaaatgtaacatttaaacatatgtttgtgtggacatatgtgtttggaacatttcatccgaagtctgacgcttaagaatacactttggaaaatcagaattagggccttcaagataaactagaatgtgataggacatcttcatttctggtcaaagttggaagtttaggagagcctcaaaagtgaagaattcgccaacaaccatggtgaatgcagtgtactgagttcttgtaaccacccggtgggatcttcttgcctgctccccagatagagccgatttctcaagaggggaattataatagggaaagagctttacacacaaagactcaaatcagcctccatgaatatttggaggctagaatttttccaagatagtttggcagggagaggaggtggctagggaatgggtgctgctgattggttggagatgcagtcataggggtgtggaaaatggtccttatgctctgtatccacttctgggtggggtcgcaggactggcttatgggttcacgtcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagccgaattcaggctcctttcatcctcctaacttggcagtctttcattagttttacaaaggcagtttagtttgggggaagggctgttaccatgtaaactatacactaaatgtttcccaaatttagcttggcccaagtccagaaatgactaagggcagtttggaagtcaaaagcaagatgaggattggttagatcagatctcttccactgtcatcatttagttataatttttgcaaaggcgatttcattctttgctatatgttaagctgttaacatgccttatgtcatgaaatcatcatcatggccctactaactcttgttaatggactcttgtctatattttaccctgatatccaacctgctgtgagacctcttgcttttgtttgtttgtttttattttttgttttttgagacagagtctccctctgttgcccaggctggagtgcagaggtgagatctcgggtcactgcaacgtccacctcccaggttcaagtgattctcctgcctcagcctcccaagtagctgggattgcaagcatgcaccaccatgcctggctaatttttgtattttttagtagagacggggtttcaccatgttgacaaggctggtctcgaactcctggtctcaagtgatccacctgcctcagcctcccaaagtgctgggattacaggcgtgagccactgtgcccggccaagacctcctgtttggaatggctttcccctccattccaggcctctggttatcagagatgaggtagcttaagcccttcagtgcttaatccctggcccaggcagaaggagggctttggcaaatccgcatgctagaaaagatgagtttggaagggcctggaaaccagggtacatagttccttttcccttgagattttagaagttgacagacggtttgctggttttgtagggaaatcctatctgccacagagcatgtggattacccagggaggatcctggaggtcacgtgcccagtaccacctctaagcacagacagtatgaccttgcctttcactctgggctttgtgtaaggatctcccaggacatagatttcatagcgacattggtcgattgctctgattcactttctgcctttctctttcttgcatatggagaatgtgggaaagaatcccctatacacacccacaggagttagaacatccttcttatcctccataatcgtgccttcaaattaataattatggcttgctgtgtgttgggccctgagcttaacctgcattatgtcacttgatctcacaacaaccttctgagggagaaactgtcattattccccttttatggattggggaactgagactcagagaggttgagtaactcagccaagaacacacagcaaaccatatgatagagtcaggatttgagctcatgattccaaagtctgaacttgaaccttctatgactataattctaattagatataagcttccagatcatcagactctgtcgatgccataatctctttcttacatggcagagatggtcaggatacctgccacgtggtaaagacgtggatgcagaagttaacctccatttgattagcttcggtgcaccaagctgcacccaggtttctctcgaaatcctgctcctgagtgggtgagtgccccgggaagagcaggtggttggcgtttgctcagttttccagcccctgatcaccctgatggcctctagccagcttttctctctgtcctcctccagtgagggccaggcctggcacaggcagcctcccaatgtttagaaggttccgatttaattggtctagagtgtggcccaagcatcggcttctaaaacctccacagggagttctaatatgcagcagggagaagcagcagctcagtgcagcaggcaaggctcgtccacggaagggctgggggaaggaaggagatcatatttgccttaaaacttggagttgagctcatctgacctaccctctgcaggtcttcagggggactgggaagaatccatgcaggagatagccccagagatcaaggggatcctcaaagagatgggatcttaagatagagggagggtacactccttgcaacagatcagcaccctgaccctgtacccagcctcgtccacaaacctgctccctagtgctgggcatgggatacagagctaggggtcgtgtggtcccccggaggcctacagtatatacacatgagctgtaacttgcttgtctgtccctccccaagttgacctcagtttatcacaccttactgatgctcttctgccaatttagtgtttgaggaccctgtgagccctaaaggtctctttctcttattttattattttattttattatttcatttatttattttgagatggagtctcactctgtcatccagtctggtgtgcagtggcatgatctcggctcactgcaacctccacctccttggttcaagcgagtctcctgcctcagcctcccaagtagctgggattacagatgtgcaccaccacacctggctaatttttgtacttttagtagagacggggtttcaccatgttggccaggctgttcttgaactcctaacctcagatgatccacctgccgtggcctccaaggtgctgggactacaggcatgagtcaccgtgcccggccgagataggatcttaagacagagggagggtatagtccttgcaacagatgagtaccctgatcctatacccagtgtcatccacaagcctgctccctagcagggatgggagagggagctagggagggaggggcatgggagagggaactagggatcgtgtgatcccctggaggcctacagtatatacacatgagctgtaacttgcttgtctgtccctccccaagttgacctcagctcaccacaccttactgtgttgaggtataatttacagaagactcacttgtttgtttcatgtaatcttgaatgatgctcttctcccaatttagtgtgtggggacctaagagccctaaaggtctctttgtctattttagatgcaccatctgaattcaagttagaatcttttcccaatcactgtttgttagtcaagcttgcagactgtgacagtgctagatgttttggtctcttcttccttgcctcctcctcctccttttctgattctgttgcagggatgttattaagaacaccatccacagcacagtgtgttcaaacatccatgcaaaacatttctcttagacctaagttctagagaaagcttatttttctcctcaaaaaacgattttcattatagaaaatatgaattttgttatgttgcatatatttctgattgctttggtttccaggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatactcctgcctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatgagttggatggagccttatgtaaattaaacaatgctgacacccaaggaactgaagatctttagtgaccttgatctgggagatttttaaagcaacttctcctactcatgaaatcctttcattcattgattcaacggatatgtattgagtgtcaactgtgtgctagatgttggggacatgacagtgggcagctcaaagaaaatgcctgccctcatggagcttccactcttgtgagggataaaaataaacagatagatattaatataatgcccgtgtggtaagtgctgtcaagaaaaacaaaggaggggaaggggatggaaagtgacaatggggcctatgagtttagagaaggtggtagggagggtgttggtgacagggtcacattggagtgacctgaacaagatgagggagcaaactgttgagtgtccctaggggaagagtcatgcaggcaggaagagcaaaaggcagtgattctgagaggtgagattgagtcccaagtacagtaggaggacagaggaaagccttaggaaggtggagtgacatgaacaaacttaagtttctaaagcatcgttcaggtgtatagagaatagaatggaccaggtgcagtggttcatgcctgtaatccagcactttgggaggccaaggtaggaggatctcctgaggccaggagttccagacaagctggggcaacagagtgagacctaatgtctaccaaaaaagagagaaaaagagaatagaatgtttatgagagcgagaagaggggaagcagaaaacagggtaggagacaactgcaggaaaccaggctaaggatcaaggtggctcagatcagcaaagaggttgaacttagtatatattttgaatgtagagctgacaaatcttgtgattgtactggatgagagatacaggagagaggaactgagggtgactggatttggctttggacttgtggcaagtgtatgttgaagttgagcagttgggaagcaagatcttgggtccctggctgtctctgcccttgcacactagtgtggccatttgcactgctccctcaggacaaagctcccgggccagttgaaaaccggaggttggtgctttgtacaaagctcaccatcagccccctttgttgtttggtgaaaagatgatgttgacgatcaccactgtaatgggtagaattgtgtcctcgtaaacaatgtatgttcaatttctaatgaaggttgcctcacttggacatagggtctttgcagttataagcaagttaagatgtggtcactctggattagggtgggcctgaatccaatggctggtgtcctcataagaagagggatatttggataccgacagaacacacagggaagaataccaggggaagacagaggcagagattggagtgatgcgcttaaaagccagggagtgccaacggtagctggcagccagcaggacctaggagggaggtgtggatggaacagatcctccctcagaatcttcagaaggaaccaaccctgccagcaccttgatttgggacttccagcctccagaactctgaaataataaattccttttgtgtgaagtcactcaggttttggctcttccttttggtcatgctaggaaactagtagaaccaccaggtattaaatatttataatttgccatgcacagtgctaagttaaggtgtgcactaagatactttatcccataaaactctctcagcagcaccaaaagcaaagtattgttggcatctccattttataagatgaggagaagattgaggttcagaaaacagtgaatttctcaaggtcgtacagcttgtatgtggcaaaacttggacacgtaccaggttttctaactctaaaagtccatgccctaaccattatgcaacgctgggccacagtcaggggccgagattccaggcacgctttgccattgggattcgccagtaaagttcatcaccacaaactttccagccaggaatccctgggctactttcctctgttttatttgctgtcatcagagttctgctatttatcacatctctcccagaagattcttgggggaacagatgtggcttggaatttgataagaacgtcacttcaacacatcctttcagtctgtttggaatcctcaccctggagagagagggacagctgaacaaacagcccacgccctctatgttggtattaaagtttctggaagctccagaaactgcttgagacaattaataagagatcatttccatttaaaggaacatttttgaacgtgggcatcaccagccagggcaatggctacttttctgctcttttcctctcccatggcaaaacttcacagcatatggccgggcgcggtggctcatgcctgtaatcccagcactttgggaggctgaggcgggcggatcacgaggtcaggagattgagaccatcctggctaacacgatgaaaccccgtctctactaaaaatacaaaaaattagccgggcatcgtggcgggcgcctgtagtcccagctactcgggaggctgaggcaggagaatggagtgaactcgggaggcggagcttgcagtgagccgagatcgcaccactgcactccagcctgggcaacagaggagactctgtctcaaaaaaaaaaaaaaaacttcacagcatatgtggaggcagaaaggtctgcccaagccacttgatggaagcagggccgtgtttgtcctgcttattgggcacatcaccagtgcctagcatcatgcctagaacaaaattcccaatagagcttgtagacctgatggaagaactggaatcgtgactgcagcatgaatgcacaccaagctcatctcgccaagcaaatgttagtggttgtataagaaatagaaaaaggaaatgactgttctctctgtggctatgtgcaaggtggataggaaaagaggaataggaccaggatctaaaactgaatttaaaatattccagcactgatttgctcaccactgaacacttggcacttagggcttgatgatgggtgtgtttaagggcatggatttaagggacaggtgactaggtgtcacttcctagtggaatacggacgagtcacctagctttgttaagccctcccttcttcatctgtaaaatagggatagcagcagtttccaccttacgtatttactgtgggaattaaataagataatgcatattggaagtaatcagtgggcatgtacatggttattgttataaagtccaaactgtcccaacgttgccctttttttccttggcacaaacactaggcctttgagtatcacaaattctttgtccagccaccctacttggtggctggatctctgtgattctattagagacaattgtctgctacatctcagagagatgggagtcagcatctgcaatttgatttctgaagcttaagtgctcatatccttataggaatcataggccaaggtttgtagatccagatcgtttaatcctaaggaagcactgttcttttccctttggctgaaatatgcctcctgtgtccccgccttgctagtcctattgatacttcaggtgtcagcttaaccatcacttcccgaagagcatcttttgctgacccactcagcgatgttaagtcttccatttaaacactccaagagcaatgtgtacttctgtttcaggggtctcattatgattgatgttaggtagttatttgtacaggagtgtaagcttcatgagggcaggaaccttgtcgttctgcattcctggtgcctatctcagtgtctgacacatcctagaccctaaattaatgttaactgaaagaattgtctagtcttctaggtgctggataaaactaggaaagttgatgcatttggaaggcccaatgaattccatctctgttgcctctctcagttgaagctttaaacaatattgttattattgattgaaaagagcatgcataaccaaacccaaggtggcagggaccactgctgaccaagctgggttgcaaattaaactgcagccatttttgatcatgtggttactcttcttttccctgatccttcttgaaacacttattctaaaacgagggtcagcagactattggaacccaggctactgcttatttttgtaaataaagttttattagaccatagccacactcattcacttgatccagaccgccctgcaaagcctataatatttcctgcttggccctttatagagaaagagggacttgataaatctgttctagttatctattgctatgtagcaagtcattccaaaacatagaagcttaaaacaacagccatcctatattatctgtcatggtttctgtgggtcaggagattgggaatgatcactggttggttgtggcttgaggtttttcctgcactggctggagcacctggggctgcctggtcatcaagcttatcaggtagtaccagggtttcttcatggggtcttgttccctggtctagcattgtgtcttggggtagaaaggaaagaaactgacagaagctacagcctcagaagtcttgcagggtctcttcaccacattctgttcattaaggcagccgcagtgcctgcccaggttcagagactctggctctgattggaggagtatcaaatatttgtagacatgttttaaaacctctataaagtatcacttccttcgtgctatggggacagctctcaaaatgtaactccaagagaggacagagagatttatatcgaaaatgaaagcttgattagaatattaagaagaaaaggaaagttttctctcatcctattaatgactgctgagaaagtgttaggaaaatcaggatggaaggattctgtcagctttacctactgacatctcctagccaccttattaaatgaatcaattttgataatatctggtgattataatcaacataggaagaatatgtttattaaaatgcagactcccaggtcacagcccagagctcctgaaggagagggagtgcttggaatctatatggtaagcaaagaccctcaagtgattctgacataggcaagaggcactgtcctttataaagactggaatttgccttgttttaggtcacatactgacatgatgctacttggcttcatgtattttaattattagtaagaatttgagctacctatgtaataattttgttttagggatctctaagatacataatccattcaaagtaatataaataaaaataactttattggaggaacataaaggtttcaaacagaaaatggctaagcctcatgagagattggaaactgaaagcaaggcctctgcttgttctcttaccttctttgtttttttccccctgcctcaaacatctattttattcctctttgcctgcacagtggtagaaaaggaccacgctaggctgagtgtggtggcttacgcctgtaatcccagcactttgggagacctagatgggcggatcactgaaggtctggagtttgagaacagctggggcaacatggtgaaaccccatttctactaaaaatacaaaaattaaccaggtgtggtggtggacgcctgtaatcccagctacttgggaggttgaggcaagagaattgcttgaactcgggaggaggtgaacgaagatcatgccactgcaccccagcctgggcaacagggtgagaatctgtctcaaaaacgaaaaacagaaaacaaaacaaaacaaaacaaaaaaggaccactctaggaagatctgtgtattctctgttgagggacccaggactgactcctcagagtaccctaattcaaattcttgggagggggaatccgattggcttggctcaggttgaggaacttacctctgatccaatcagctgtgaccagctgtatccactgcccaatcagaaggttcttctaataacacagagttggaagaagtgaaaggcatgctagggttttcatttccaaattaaactgcagtcattttttatcatgtggttactcttattttccctgatcttcttgaaacacttgttgcaaaacaagggtcagcaaactattggagcccaggctattgcttattgttgtaaataaagttttattagactacggccacactcattctcttgatccagaccgtcccgcaaagcctataatatttcctgtttggccctttatagagaaagtgtcctgactcctgctctagaattcagttcgcttctatgtctaaatttttgctatgccttatgcatgcccgttctgttttccgttaatcagtatagggcatgttgttgagggcagggcaagacactgggaatcttcacacacccctgtttattgatttttaaaactatctgtacaaatgcaatagtatctcctacgatgcggagcacatagcattgctgatttgcaagaagatttcaactgctacttgagattgttttaggtgccgtgtagttgcactatgaaataaaattaaatcacgttatgataaggttatttctgtgtctccttttactctttctaattacttgaacaagcaaatctcatttgatgacaatatgctctctaacaactttctaatacaattttttcctttaacaaggagaagatgcagagcctgactcagaaccttcagcagccagcagtatatagctagaatttactggcaccgctttgcttttatttatttttatgcttatcttccatttatgacttgtgatactggcttgccattaatagtggtgatataaagtttccttttcaaatttagttaagttgaaatgtgactagatttttaaaatgctaagcaaataacagtttaggtggcaggaagaaatgtgaaaaaacggatatgaatgattgaagtgcggaaatgcctgagctacagtaactgacatagttacaaagcagccctggtgcccagaggaggtagtggccgatttggtctgaatggaacctccagattagaggaggagataacagcccagtggaatctcagattttcaaagcagtgcaagagcatggaaggacgtcatagacagtgggagtcgaatgttcaaaggaaaagaaagaacaggatgtggtcatggaattgtttggctttcaagagccactgaagggctttcagcattcaagtggcacagtcagagctgcattttcagaacagtcattagctgaagcaagttaatctccctgagcctcagtgtgtttatctacgaaatgggggtaattgacacagatgtaggatgtccacccctgtccctggtgaagggggaaattcccagccattctgccctgtctctcttccatgtggaaggctaagatgtcctatcatgactgcatctgcactgaaggtgtctagggcccctccttctctcgttttggttgggggaatgggagatagttgcagatattcaggattgttggatggtgccttgaccggtggtgatgggtcagggagagtgtattagtccgttttcatgctgctgataaagacatacccgagactgtgtaatttatgaaaaagaggtttaatggacctggggaggcctcaatcatggtggaaggctaaagtcacgtcttacatggtagcagtcaagagagaatgagagctaagcgaaaggggaaaccccttataaaatcatccgatcttgtgagacttattcactaccactagaacagtaggcaggaaaccgctcccatgattcaattatctcccaccaggtccctcccacaacacgtggaaattacgggagctacaattcaagacgagatttgggtggggacacagccaaaccatatcagagggtgtccactgtcaaggacagctcagcaccaagcccttcttactgggctctggagtttctcagctgagaactcttcttctttccatctccaattcctctgctcacttgtcttccagctaagtcacctccctgccccctccctgcacatgtcccggccccagctctctctggaatccaggagcaggaagtccctgtctccacctgactctacatcttaggaaagtgactcccttgagtcattgtttctgtgttagtaagcattgaggaaggaaaatacatcccttgggtaccagggagagaacagagggaggcaagaaataaactgaaggtgcccatcctagcacttggagccctgtcttgccatgcacgtaagcagagggtctgcaggagccactcagactggcagcttttcttttttattgtgctggggaagaaagaggttaaaaagagttctcttgctgtggaagtgtgtgacagggaccctcttcctaaggtgtcccaaatccctgcatctgcctggcctttgtcactgtggctgtgatgagagagaagatggtgaggacaggagataggaatgctgtgagctggcaagctcagctcggaagcttcagtgcatgggtgcatgatctggaagcttctgtgcatgagtttagccagaccttttgctgctgggataagagctgagtggggtgtgcagagctgccttcctgctgctaagcttattctatatgtcaccccttctagcctgagtcctctgttgcatcctctggtcctccagctgagttgagtgtagcatctaatttcctcaatcacctgaactctggccctgattggttcccttaccctcctgagccttaatttcctgcaatatgggattcacaatggcacctacttcctatgatgttatgcaatacaaatgagtaacaataagtgaaaacctggaattgtttggtcagtagaaaagtgctcaaaaatgtaatggtggttagtattgttgcctgcaaaatatctgacacagtgcatgcagtgaatacttcaatctgattctttcttcctccaggaagccttcctagaagtccccaaaccaggttaggactcttcgtaatggggttctgccttgtgcttcctacagggcttcttgagacaatctgctggtcattgttctgtctggcataatcacaaccaaagaatgttcaaagaatattcccccggttgggagagtgggagagggggtgacacgcagaaaataccgatgtgtctgtgagccacactggttaactggccctgaatatgaccacagcacagctcatagaaggaagccccaagacaacaggagaggctgttaaaatattaaattaatcatctctgtaattaatttgcaaaatatttcttcctctctggagttaagggtcagagaacgtgcttgtttctttattgctgtatccccagtgcttagcaggttcttagtgaacattaaatacttgaattaataaaggaacaagtgccctaattttagttttgtcagtcattcactcattctgtcattcaacaaacatttattgaacatgtactatgagccaggagctattgcaggctcttgggttacaccagtaaaccaaaacagcaaagatacttgccctcatggggcttaccttctagctgggcattgacacattgcctgttacctcagagggatcaatatacaatcatctcccctggaaccatcctctcttgattgagttcagctattcaaagtgcgaggtcagggctggatgcagaatcacccctgtaatcttagcactttgggaagccagggcaggtggattgcttgaggccaggataccagcctgggcaacatagtgagaccttgtctctacaaaaaataaaaaataaaaaaattagccggacatggtggcacttacctgtagccctagctacttgggaggctgaggcaggaggatcactgagcccaggatttcgagtccgcagtgagctatgatcatgttactaccctctaggctgcagtgagtcatgatcatgctattgcaatctaggctgggtggcagagcaagaccctgtgtctgaaaatataaaagtgtgaagtcaatagaaaacattacctgttgtttcagagtcaacagaaggcacctatacaaagctaagtgtggctacaaatgaacaccagctgctcataactggcccccagactccttccaactgccctgacatgcttgctctctttcccaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggtaacttgtcccatggccctgggtattccacctccagggcttcaccaggctttggccaaagctatcttagcagcacccagcacagagatacctgcacccttccctttctagacacagaaagatgtaaggcccagggaagtcagctgagagttctgaggttgctactgagaaacgctctcccctgagacagatgctgtctcaacttagataaaggaattcaggcaactggttttataattaacagagcagggcctttctctgacagcaaggagtgacttggggacaggagctgggtgaaaaggttcacagcttgtggatctagatggttccattcagccctctagacctttggataaatgcacaagtacatctctgcaggttgcctgaggcctttgcatgggcctcattggagggaggatgttgcctgagaacacagccctcgaggactctcagggaaggtacacagtgtcctgggaaggagctagtgagttcagagccatggctgccaaggtgagaagggagcacttgtccatttgtccattttctgctcttgactgtgatttcaaccctatctgcaagagcaagagtccctgctttaagtaacctcttacctttccctgttcaaattagaccttggtttccatacccagggatggagaggccagagcccaaatgcaaaggggtacaaagttaattgatgccttttaggattctcagggccaatgacctggtgacttaagatgttttggggacttttcaagattaattttgactctatccagttctcaacttactgagtagagtgactgattttagagcccaacccatatatgagatgggacactacagtactttgcatctaatttgatgtctttagtgatttccctctcactttaattcttttcttttatctgttctattatctgctgaagatatcctgggctgtgtgacctgtagcattttcacagtctggatttcactgactgtacggtcttggggcacctcaacatgtttcctctgtcttctgtatttcgtgcaattggcagctggttctggaggcttggtcagactcagctaggatctctttggcaagaccatagatggtgacctgttctttcatctgaagtcgtataatggcttgttgtctctcatagtgaagttggcagcgactgatggttggtgcctagatctgttaactcattagggattgtaaaatggtgatatcctaattctatcatttatttttcatttactagtgagaatgcctttataaagaagggcctcccttcacctattacttagttccctagtggtatagttcctgtgagaaaggcaggataaatgcttgattctttctctttatttaatagttctcaagataataaattggttcactgttgtgctccaagggtggctaaagttggcttttttttttctaaatgggtctggctctgtctccccagctagagtgcagtggcatgatcatggctgactgcagcctcgatctcccatgctcaagtgatcttcccacctcaacctccctagtagctaggactacaggcacacaccaccacgcccagctaatttttgaacttttagtagagaccgggtttcaccatgttgtccaggctggtcttgaactcctggactcaagtgattcacctgcttcggcctcccaaggtgctgggattacaggcatgagtcaccatgcccggccaaagttggcttttaaaataaactgttttgagtggaagaagagacaatagaaagaaaaatattaagtgaatgataatttacatcatgcaatggagacttggcaaagaccaggaaaggggtacacctaaccttactagtccaaatctctagtcttaccatggggatttaaggcctaaaggtgttcaagtggtgatagagacaaggctgggatttaaacctctaggctcccctactcccttaccttctcccttttccattggttatccccagatggattcattgacatcatcaggcaaaggacagtctccgtccagtaaatcaactaagtaagaaagggaccttgtgcccagcatagaggctgagcagcagcagttttccattttagttggatatgttgagagtgggagaaatgaatcatgggtgactaatgttcattgtagtgtctttgtggtttattattttaaaaatgattaaatagagtagatttgagattattcttttaatattgaaccaacctactcacctatatttcaatatgctttctggaattagagagtaggggctgggtgtacatggaaattttgcagaagtctgggtcccctccagggattgtcatgtgccagggaagagagactgagaaccaggagagcctagaacacaagagcccagtgggtttgggtcttgcatggtgacatgatttggctgtgtccccacccaaatctcatcttgaattgtagttcccataatccccatatgtcgtgggagggaccaagtgggaggtaattgaatcatgggggcggttacctccatgctagttatgatagtgagtgaattctcacaagatctgatggtttaagagggacttttaccccacttcgctctgcacttctccttgctgctgccacgtgaagaaagacacgtgtgcttccctttctgccatgattgtaagtttcctgaggcctctctagccatgctgaactccgagtcaattaaacccctttcctttataaattatcccatctcaggtatgtctaatggactaatgagaatggactaatacacatgggaatgaaggcctcccatgttggagaccaatgcaagtaattgaatcgtgggggcagtcacctccatgctagtcatgagagtgagtgaattctcacgagatctgatggttttatgagggacttttaccccatttcgctctgcacttctccttgctggtgccatgtgaaggacacgtttgcttccccttctgccgtgattctaagtttcctgaggcctctctagccgtgctgaactccaagtcaattaaacccctttcctttataaattaccgagtctcaggtatgtctaatggactaatgagaatggactaatacacatgggaatgaaggccttcccatgtggagaccaatgcagaatctccccaaccgacaagtccaaggatggaacagattgctttctcagttgttgagggtctgatgaagtctttaacctatctctagggattgtatcgattgaaagaaaaaagtgcttggagagacgcactcactgcaagcaagagaccctgagatgccaagtgcagttggctgaaggaagagcagatccccttccatctcacctgcactctgcgcatatgctcattgagtgaaatgctccaatttaaattattttttctcacttctttgtgggctaagcacatatattttaatgttgcataaattaaatttattttcaaagacttataataatgcctactatatgtgaggcacaaggcaaacaattttaagtctcttgacaacttagataggttctgtcatcattcccattgtgtagaccaggggactgaggccacacagctagtacatttcagggccaggatttgaacccaggcagtctggctttaaggagttttgcatttaattgctatgctctgagatctttttaaaaaaacatgtatatgtataagtatatgtatatgtatatgtatatgtatatgtatatgtatatgtatatgtatatgtgtgtgtatgtgtgtgtgtgtgtatgtgtatgtgtgtgtatgtgtatgtgtgtgtatatgtataagtatatgtatttttagagacagggtcttgctctgtggcccaggcttgagtgcagtgaaacaatcatagctcactgcagccttgggctcctgggctcaatagatcctcctgcctcggcctccctagtagctaggactacaagcatgcatcaccacgcccagttaatatttaaaaatattttgtagaaacagggtcttgctatgttacctaggctggtctcaatcttctaggctcaagcaatcctcttacctcggcctcccaaagtgctgggattacaagtatgagccaccacacccagcctgaagtcttttgagtgtggatcacccaaagaccactccacctgacacccctgggttagaatccctcctgcaggcctgtctccaggctccaccaggagcctgtgctctaatctagccatggtcacctctcacctgttcagtgaagccacactacctccacctcttagcttccctatctctgcataaaacttgatgttccatctgagcctctaccatgcatgggtcttcaacaacgttgcttcattccagcctcacaaaaatcttgcagtgaaagggattatctactctcccattttgcaggtgaaaggattgagaatcagggctgcatggtagttcttcctcgacacagcactgggtcattggctcattgagctcagagcccaagcttttgttagtacatcatgttgagttgccaccaaaatggccttgacaatgatgatacaaacaagaacaaaaagcagcagctaacagtaataggttgggcactctactcagcactctagctgtattatctcattttatcctcctgatacctctattggaaaggtactattactaactttaatttacagacaagaatgctgacattcagagaagttaagtaactggtgcactgtcacacagctgctaagtagtggagctaagatttgctctgcaagactctagaaccccaaacccggaagcctttgctaacctacctgtgccttaacttcacattcctggttttggcttatagaatattttcactttacagccaggcacagtggctcacacctgtaacaccagcactttgggaggtgtaggcaagtggattgcttgaatccaggaggtcaagaccatcctgggcaacatggcaagatcccatctctacaaaaaattagctaggagtgatgcacgcacccgtagtcccacctacccaggaggctgtggtgggagggtcaactgagcctgggaggtcaaggctgcagtgagccatgattgcatcactgcactccagcctgagctacagactgatactttgtctcaaaaaataaaataaaataaaataaaatataaaatattttcactcttacgatcacatctaatcttcacaaaagcactataagtattatggtccacatttctattcaatggaaactgacccccagaaagatgaaatggctcaagttccacaatcagtaagtggcagttccagggcttgagctcaggttttctaatagccctttgggtgtttttttttttttttttttttaatactatggaagttactccgcttatcctacagggatattgcaaggattagataagattttatccatgggaatgattattaaaatttagggagcactgcatatacatgaggcaagccattgttatcatgactaaaatgagcaggaaggtgacacctctttctggggatgtccttgaaaatggtcatctggctcctgctcattttctagcattgcatggcctggatctgcagagcagggcttcagaggaggcagtggagctggaataggccatatccctaaaagggcattactgcctgtatacagagggtattactgcctgtatgctgcctgtatacagagggtactaatgcttattgattatttcaacaaagacttattcattgaaataattgtatcaggccccattgcatcaccatgatgaggtacaaaacagataaagtccctgtttctttggaatttacattctcttgggggagactgataataaactataataatgacacaaagtaaagaggatggagatggatggattggggcagagagatgctatttttgataggatcatcaaggaaggtctctctgataaggatgacatctgagcagagaccagggcaagcaagggagcggggcatgtggctatctgggggcagagtgttccaggcagcaggaagagtgagtgtgaatgcccgcggcatgagcatgctccgcgtgtttgaggaacagcgaggaggccggtgtcgccccggtggattgtcattttgtattttgtgacccagaattctttttgaatcagctacctttaaaaaaaaaagagacaaatccaatataacatgctgtaaatttgatgtttttctttctagagactcagaattttaaagataaaagattcttaataggctcttaaaaaatctcaaaagtggccaaaatactggataaaagtgaaagagacaaccagcaatgtacaaaaccattttttaaaaatcaatttttaaatgatgtaaattcgatttttaaaaacttatttaaaaaagcaaagttacatcagaaataatcttatattggaataaaaatatctttcaaacatatgcacagcacggtgttaacagaaaatgtaggatattaaatcctatttaagatattattttaagtgtgttaaaattgaatattcacatggaaaagaatcagaagggggcataaacaaatcaaaatattgatttgatttagggaggggtctgtggataagtgccttctttttgaacttacatcattgcagaagtagttataatatagttgtttaagttttttttaatgtaccacaagatggcaaagttaatatccaaatagatgcaaaagctcccagaagggggttgagttttcagagatttgctcattagatggtttaggcaaattgtcctagaagcacaaagggataataagcctgtactccacagtcaggtgaatctggatctgtgattgcttgctagatgacctctaggaagtcacttaacagctctgaatatggatttcatcatctttaaagtgggcataatcagggaggattgaaagagatggtgaataaaatataataaacatgaaatggaggttgccggcattattagagctggactggaggtgcaccttgctgcataggtacgaaagaattatgtttcttccattccttttgcagtttttctcagggacaattgtcagcccggcacattcatgcaatttcccaactgccagtgggcacaggcagttaagtttctttagcaaaacatctattttaactgttttcttttcaattgaacatatgcacctctttttttttttaaatagaattagattttatgagtcattgaaggacagaagttacttcctccccaaatttgctgccatggcccagcaataactcagttgcaaggcatgctgggaggaacgtcaattcagaatgcaagagaggacagggatggggtgaggatgattcccacatgtagagtggacccctgatggcccaagaatgagccccgagaatgtcccaggggtcctggtaactcgggctcagctctgggctggcagcagtacccaaggatatggttggacttaagggcattgctgcaggtggctctggctgttgtctcagtcagcagtgatcaagttgtaagaaacagaacaccccttcccctgccccccaccaaactggctccaatagctccaaaaaaacagagaagacttttttttttttttttttttttttgagacaggatctccctttgtcacccaggctggagtgcagtggtataatcatggcttactgcagcctggacctcctgggctcaagcgatccccctgcctcgacttccggagtagctgggaccacaggcatgcaccaccaagcctgactaattttttaaaatttttttgtagagatggggttgagacctatgttgctcaggctgctctcaaactcctaggctcaagtagtccccatacctcagcctcccaaagtgttggaattacaggcatgagccaccgcgcccagcctggagaggattgttgatgagaaattagttaatgcgtgcaatgtaccttattcaggtgatgggtgccctaaaagccctgacttgaccactatgcaatctatgcaggtaaccaaaaaaagaggattttattggaaagaaaccacccaaagacaaaggtgtacctgggcctcatgaggagctagaatctgtaatcctaaagcagtctagaatagatttctaggtttctttgtccttgctttctttgtttctcactgctcctggtaaacatgacttcgttagctccttgcagtttgcctatctggcaaattccctgcatttcagatcatagtcctgggaaagagaatctggttggttcagcttgggtcaggtgtttattcctggcccaatcagctggcaattggttgctactaactcactaggaaccttttaaaaggggttgtatctacagggagggaataattggtgctcatgccaggtgagaggcaccatcttgagtccaaggagactaactggattcaagcaggacatagttataggctagtggtacaaacatggcatcattgcctcccaggggaggaaactggtgagagcttggcaggtgttagtgctttagccaactaaagccatccaaggatcttgagtacaggaaatgaatcagaaatgcaacccaggcaaatagagctggggcaggtgggaatagacacagccttatgctctctgttttcttgatggtggcctttgcatattcattcaataatcaaagatctgtggaattccgaggaagaatagaggtagttctagcctttgaaaactttggcctctatgtggagggacaaggcttagaaagctgaaaacaaacaaacaaaaaagctagaggagcatcaattgcttgattctaacagtgattgcaaggctataaaatacagaggaagggaaagttgtgtgtgaacacatgtcattgagtgcacacttacttgggtaaggctttttgagtttgcatggacttgacatgcgtcatctgatgtatcttggcaacacccctatgaagaacaagctgtcattacccccttttgggaaggtagagactctaagtaactgacccaaagtctcagagcaagtatccagtataactgtgactagaacccaggactagctgataccagaaccagggctcttaaccacagcactacacagcctctctggagagaaacagatggttctgagcaataaagggatcagcttccagacgggatgaatccacagaccagcttggaaaatcattaaagatcattaaatagacaaattcttgcagcaacttcccttggagcatggtacatagagctgcccacgtggtcggttttctctgttcatggtatctgattaaaagtggcaagtgtccccctggcagtcacacaggcatcatgttacactccactttcagctgtcttaggggaagattgtctctttgaattcccttgcttcctctggagacctccaggtgaattctgcacctcccacctagtcatcattttaaatcagactatcctcatactcatgttccaaatttgggaaattctagccaaccattttgcataatgtagtgacagacagacatttagttttatttatttactgattatgagagattaaggagaaagggaattttaaattacctgaaggcacttgaagcttagagggcagcggtaatagtgtaatgaagaatcacaataacaatgacaattttgaagaagccctttaaagtcaagcagactagccagtttgaagagaaagatggtgagtttgcctttccgagcttttaattggagttgacggtggaacacccacgtagaaacgtcctgtagccagctggagctgactggagctcaggagagagggagaggatagaaatataagtcaagactcatcagcccagcgagatgagagttgaaattctgagctgtgacaagttcttcttggaaaattgagtaagtaggagagagccaatctggacttcaagtcgatacgcaagaaatactttttttgattttcatatattagagtccaacaaataagccctaatcaaaaaacactgagtgtggtgataaggaagattttgcaataatttcgtaggaggaatggggaacaaaggcaaatttaagggtgctatggaggggaataatatgtaagaattagaggcagtacgtgaggtccatttagttagccgaagcccccatagttcactctttatgcctctcatgcactttcttttatcgcattctattttatttatttatttacttttatttgaaacagggtctcactctgtcacccaggctggagtgcaatggtgcaatcactgctcattgcagccttgacctcctgggcacaagccgtcctctcacctgagcctcctgagtagctgagactacaggtgtgcgccaccatgcctggctaatttttttattttttgtagagccagggtcttgccatgttgcccaggctgacctggaacttctgggctcaaaagcaatccttccacctcagcctctcaaagtgctgggattgcaggcatgagcccctgtgcccagccacattctattttagattagggtttgaattagttgtatacttgttttaaccaagattctgaattccctgagggcaagcctgaaccttattcatcgttttcatccttttaatgcctgcctaatgccatgacttgcaaaaataagcgctcgatgaaagttctaaaactcacttctctgctccagattggctctggattgcctctgacaatattttccagattttgatgttgcttactgtggagtgggagatgaacctggtggtacatgaacacattgcatttatttttaaaataagtcatttaaaggattgatgtaccagagccagactggatattgcataaagatgatggactccagatatgcacttcttttctacagagaggatgaatttccatttatgactttagtatgaaatttaaaatttttaaaataattgtgtttaagttttttttaagtgagttaataaaaatacttttaaaataagtcaattttagtagaaaaggcagacaaacttagtaaagatttttttcttttctttctttctttttttttttttttttttttttgacacagggtctcactcttccccaggctggagtgcagtggcatgatctgggttcactgcaacctccacatcctgggatcaagccattcttgtgcctcagccttccgaatagctgacattagaggtgtgtgtcaccatacctggctaatttttgtatttttagtagagatagggtttctccatgttggccaggctggtctcaagctcttggccttaagtgatctgtccaccttaacctcccaaagggcttacaggtgggagccactgcacccggtccagatatgtacttgttttctatagaggggatgaatttccatttatgactttggtatgaagttaaaatattttaaaataattgtgtgtaagtttttttaacggagttaataaaaatatttttaaaaaataagtcaattttagtagaggaggcagagaaacttggtaaagatcttaaagctggttgggagacaagtcacgtttgggtggatggtcttaggcagtgcatcataatctggtcttaccctacctttccccttttttcttttatatgactccatgaattttactccccctctccagcaataatagccatcaaatcaggaacgtaagtgcttagttgtattttccacaatatacgttaaaacaaatacaaagccataaaggtgaaaccatcatacatccatggactacctaaaatgatctcctacccattttgggaaacacggccgtttggaaatttatctggcccctgtccctcgcctgggaatccttaacatctggcactgtggattatccacagaaacatctctggcaatagagttgctcctggcatagagtgggcatcattaagtgtttgttcagaaataaaaggacagtgagatgccaaccgtaacatttaatagcttaggcactggtgtgttgaagccacatgctcagtacagttcaaagatgatagatcttagggtttccctgcatatggttagcggtagaaacataccacaaaacacgaccttacctacagtggagcgatcccctgatgtggggattccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaagacagatgctatttttaggcttgttttctattaaaaaaaaaaaaaaagccaaagaaccaggggctgggtgtcggcagttctggcttactgtctgcattttgccaccaacttgtatgtgaccttttggcaaatctcctatgccttggaccctgagaatataagtgatcatttcacctccttttctcattagacatgttgagagggtgaagcagtattggtctgagaaataaaaaccattttctaaaaattagtcagtgtgggcaacatggcaaaaccctgtctctacaaaaaatacaaaaattagccaagtgtggttgtgtgaacctgtagtcccagctactggagaggctgagacaggaggattacttgagcctgggaggttgaggctgcagtgagcagagatcacgccattgtactccagactgggcgacagagtgagaccctgccacagaaaaaaaaaaacaaaaaaattggttaacttgtgctctcctgtaacctgccagcttctgtcttgatgtaccactaaatctccatgttccttctctcccatcctggactggaagctctttgaggggaggacacatccacacatccatacaatgtctagctcagaacctttcacacaagatgtacccactggaggcagcatcatgaggggttgagagtgtagagtctggaacccaatgcctaaggttcagaccctggctttgcagcagcttatcagctgagagaccactggcaagttacttaccctttctgagcttcaactttctcctctttagaagggagagaatgattatacttgtcacattgagttttgtagagggacaagtgagacaaaatatgtaaagcattcagctcatcacgtggtaagtacccaagaaagcttaatttcattattgttgttgttataattattaggcactcccacatttgataaatgcacatatgactgttacatataagataaagttctatgtgctgtatggaagatttttttaaatggtgaattaaatgcttgttatatggccagcatcatgttagacactctacacatgtgtccttgtttaatattctgtgggcaagtgaaaaatgtcccatctacaggtgaagagaaagcccaaaattagattaaataactgctcagtgttgcagttagtaagtagtgcaacaagacttcaaatactgtattgacttaaaaggtgaaatctttgcttcactttcccaccacctcttctcccggttttatagcccctcacaatagctttgcaacttttgacagcaagtcaccttttacgttgtgactcagccatagcaacatataaatataaccaaaacatatattccacaaaaagtacttagtggtgttctgtgcagcatgcactgataatttccatttcatcatttcattatttttctttcttcttctactttttttttttttttttttttttttttttgagacagtttcactctgttgcctgggctggagtgcagtggcaccaccatggctcactatagccttgaactcctgggctcaagcgatcctcttgcctcagcctcccgagtagctgggactacaggtgctcaccaccatgcctggctattttttttttttttttttttttggtagaggcagagtcttgctatgttccccaggctgttctcaaactcctagcctcaagtgattttcctgtctcggccctgccaaagttctgggattacaggagccagccaccatgcctgacctcttttttctattatttttttttaagttgatcatgacccaccaaattgattcaatcatcaattaaagtgagatacaacttgagtttggaaaacacttgtctggcttcaatactcaggcagtattgccaggacatctcattttcatcacatttacagtttgcagccctgtgtatgtttcattccagcccctcagtcagtctgttagagattatcgcatatgttatcctcattttataaatgaagatatcaaggctcagggatgtaaaatggtcttgccaagcctccccagtagtcagaaaacgtggagtcagagctttgattccaaccttctgactgtatgaatgctgctttggagacccagtaactcctgctgcctcgaggatcacccatttattcacttaattaatgtatattgatggctcgctttggtcaggcatggtgctgggctgttggtacacagcggtaaacaaattttacatggctcctggatttgtggaacgttcagtcacatttcgcattagtccatttctttcagagtgagaccccgaacctttgtgttagcctacgtgaccttacatgatgcgtccctcagcaccaccctgggctcatctcctaccctgtcccccttcttctttcttctccaagcacatgaggtgtgctctagcctcagggccttcgcacagcctgtttctccgcctggtaagctctcactctcaatacctgcatagctgctttcgtcatctccttcaagtctttgctgaaggatcgccttctaaataagattatcctgaatactttattgaaactggaactcctttctcccatctcatccagctggtactcccaatcctccatactttgctctgtttttcccccgtggcactttttaatcttttagccttctatttttatttttatttatttatttattttttgagacagagtctcactctgttgcccaggctggagtgcagtggtgtgatcttggctcactgcaacctccacctcccaggttcaagcaactctgctgcaccagcctctcgagtagctgggactacaggcgcacaccatcatgcccagctaatttttgtatttatattttagtagagacagggtttcactatgttagccaggctggtctcgagctcctgacctcaggagatctgcccgcctcagtctcccaaagtgctgggattacaggcacgagccgctgtgcccggctatcttttaatattctatataatttgtttattatgtttagcatttattgccttttctgtgtctacttgctagaatgaaagacaaaggccaggaatttttgttggttttgttcactgctctatcctcagcacccatctataacctggtacctagtaggactctgtaaatttgtttttacttgaatagatagatgaaataaataaccatcaagttcaaaatataattaacaaattatgatgtggtcagagattaaaaaaagaaaagaaaagaaaaaagcccacaggctttcatgaaagagtataacggcagacctaatttagattgggtgggttagaggaagtgacttttttaggctgagaacataagagggacttcagttcccaaattcgttagcgcagactctgccattgcaagccaaaggaacgtagcgtaaaggagagatttcacccaagcagaagtctctaagaagagataaagtgattcattcattcatttagcaaacaccctctgatggaaggagagaaacgagtcacatattggtgttgcccaagggccaaaacacacatctgacttatttaattccagcaacatcactgaggttctactattatctcctcttgacacacaaggaaacccaggtgttgaataacttctccaaatacatccagctattaagagacagagctggatttccaaatgaagtatctttggcaccaaagcttgtgccctttccctctctgggcacctgctatgtgctagttgtgctatcagaaacagggcttacacagccaacaagggcatagcccctgacttgaagaagttcacaatatcccttgaaagacatgctgaaaaacttccctgattaggacacagatttttttttgtccccagttcttttacttctggacatgccttcctagattactgtttttcaaaccttgataattcatctttttgtttttgatagccactatgttatctattggtgagtacctcaaaattcagtggcttaaaacaataagcatttattatctcagtttctgtggggcaggaatttgggaatgctttacctagttgatctggctctgggtctcaaaggaagctgcactcagattgccagctggaattttagtcatctgaagccttgtctcgagtgaaggatctgtttccaaggtgattctctcacaggactggagttggtgctggctgctggcaggaggcctcagttctttgccaaatgtaccttcccatagtactgcttgagcatcctcatggcatggcggcaggcttcccaaaaagcaagtgatctgagagagagcagggtggaagttgtaggtcttttacgcgctactcctggaagtcattcattgtcatttttgcagtatccaatgggttacacaggtcagtcctattcattaggggaaggtactacacaagaacataaataccaagagactgaaaaatcactgtgggtggggggagcatcataaaggctggctactacagctatctatcacctgtaacattatttacttaatattttccactttttgttaaaatcagccttatcctaaacaataatatcagttaagtcacaagattaatatgctaattgtattttccagcaaaaacaaatataaacttgtaattattattattattattatttttgaaatggagtctcactctgtcacccaagctggagtgcagtggcatgatcatggctcactgcaacatccccctcccgggttcaagtgagtctcctgcctcagcctcccgagtagctgggattacaggtgcctgccaccacgattcgctaatttttgtattttgttttttttcagtagagatggagttttgccctgttggccaggctggccttgaactcctgacctcaggtgatctgcccacctcagcctcccaaagtgctgggattacagctgtgagccaccatgcctggccaaagttgtaattattaatgaaaaaaattatctgtgtatcacctatgctcacttgcgtagttccagtgacacaaaccttacccttggggaaacaggaagcccagcaaacagggatctgtcagagagccctggtagttttcatcataaattccagctcttcccccactgtccatttggagccccagaagctacgggatgctaatgttgctgtttgctgtcctcttccaggaccgcctgtactttgtgatggagtacgtgaatgggggcgacctcatgtatcacatccagcaagtcggccggttcaaggagccccatgctgtgtaagtgagaactagtgctgtgctttctccttgggataaatgggtaggttagtggttcctttgagggtgtttttttgccaaagagggatctttaaacacctcgggcatctttttgaaaaaatatttagccagggaagaaaggtgttctgcttaatatgagatacttcttttttttctgacaccagctaagaacctgaagctcagacagacaccatggctcatacctgtaatctcagtgttttgggaggctgaggttggaggatcacttgagctcaggagttagaggccagcctgggcaccatgacgagatctcgtctctataaaaaataaaaaacttagctgggcatggtggcgcacagctgtagtctctcctaaaaataaaacaaaactcaaagctctaaaaccacagctatttatttatttctaattcatgtccctgactgcttagaaaggccctatatcttccttggggattatcattgtagattttatgtgtccatttgctaatatttattgagaacttactataagccaggccctaagtgcttaacaaacatcgtctcacttaaccttgagaataactctgggagggagatgctaccatccctgctttacaaacaaggaaatggagatgcaaggttttgaaagcttgcccaaaatcatggagctagtaagaagcagttcccaaattctgaccccggtttttctttgcccatgttctttatcttacaccactctccgtcttagatgccttcactccatgggggtgaaggatcaaggtgctcggtggcaatggtctgtggttcctgtgatggggagactgattctgggttgttggaaatgtgtttcctctgctgagtcaattccatccccttcggttcaaaaggcagctacagtctcttctttttagaacacagatttcatcatgtcattcccctgcttaggaacatggcaagttataggaattagcaatgataacctctcctggggagttttctaagatcttattgcctctccagagagcccccagagctcatctagaaccccaccttgtcatactagaggcttggtggctcctacccagttcagcttgccccctctcctcccacctggacaggttgtgagcactatgttctgataggatttgcattattcttgtgcttccaaatctagccatttgtatctcctggcatgactctaataggactagctttgcttttacttctaacatctaattgaccacaggctttaattccattgtcacacaagacatgtcaagacactttacatagttccccaaagccctgcccaacctttgtggcataactgggcttcccagttctcttgaaacctctttctttctgtgctgaccttcaataagaggttacactttagacagatgttgtttcttattccagctgcgccattcattcactatataacttgcccaagttaatctctctaaccctcagtttcctcatttgaggaatggggagatactagtaggacctaccttacaggattgttattaggattaagtcaggtaatgcctaaaatggtgctggggagatggtaaaccttcaacagatgttagctgctattgttaagataatttaacttgctatatagtctgaaagtataattctctcttttttgggggggtgggggacagggtctcactctgttgctcagactggaatgcattggtcctgaccatagctcactgcagccttgatcacctgggatcaagcgatcctcttgcctcagccttccgagtagctgggatcacaggcatgtgccaccacacccagttattttttttcttttatttttagtagagacaaggtctcactatgttgcccagctagtgaaactataatccttcatccagttcatcatatcccatgtccccttctccactatacaattgctgaacttctgcctacccccagtttgtccttaaggcaaccccatcaccctctaaaccaccctttgaatccatctgtactttcagcactttatgagctatatagctgaccatccatgggttctttaatgtcctacacctagttcaatattgtattgaattctgagcattgccaagcatatggtgtccttgagtttctccatcgctttttttttttttttaatttcagattttacgctgcagaaattgccatcggtctgttcttcttacagagtaagggcatcatttaccggtaagtgaacactgctgtactttccatctcttcatctccctcagctcctccctgccctgcctctttcttcagctgcttttaaaattagaatccgcggtgggggaggaatcctccagaactaacttgggcatgtgttctgccaggcagcatcgcccactgccctggcaaagtttgggcagctctatatggtggtagaaaatctcggtggactgtgtcaccaatgatggttcagagcctcaaacaggagactgtttgctctaagaggagactcacagagaggacctcagtacttctttctcttgcttgtggaccctacatttgaggagcaggcaaagaattttggctggcagaatgtgatggatcacattattatgaaacattttttatttatttatttttttctgctatgtaagtacaacttggaaatggatctctgagtggctgccctgaaagacaggattaagttcaggacttggcatttgctggtttttggaggagcaaatggatgatcatagctgcatgagtcataccattttatatttcatgcaaggcagacgattgcacccgaggctgctatttgtcagcaagtccagggcgtacaattctccttgtactacattgatgcaaatggcatagccagggcaggcttgggctggtttgttatgcaagagaggctgcaaggtatgaggcctccaaatagcatttggcatgggtgggggtctatttcaaagattatgaagaaccacaagagtctcttccattcatgtgtttgacacacatttatcaaatcctactatattctaggcactcttctgggtggtgggcatacagaagtgaataaaacagatgaaaccccttgcccccgtggagtttatctttctcatggtgggagttagataagtgaatcataaaaacatagtctgccaagtagtgataagtactatggagataaatcaagcaggggagggtgctggtgtacactgggtgttggagggttctctctcattctgtagagagcatgatgatgagggcctggagagttaggggtgacttgagagtcctgggccttttgccttaactgcgggatatgggattaaaaggcatgagggggctgggcacagtagctagcacctgtaatcccaacgctttgggaggctgaggcaggaggggtgcttcaagctaggagctccagaccagcctaagcaacatagtgaggcccacatctctaaaaataaaataaaattagccaggtgtgatggtgcatacctatagacctagctactcaggaggctgaggtgggaggatcaattgagcccaggaattcaaggatgcaatgagctgtgatcatactactgcattccagcctgcgtgacacagcaagaccctgtctcaaaaaaaaaaaaaaaaaaaaaaggcatgttaagattagccctggtaagtacaaggcagatagcggaggccaggctatgggatgctggtaggatggagaaatgggaagtggggaccttgtcagaggctttcagagtcctggggcttttagtcacacctgaagtggtgatatggaatctatagggggaaggatgatcttattctgagggcacaaagtccccgccattcctactttctcctaatgatggagggaagaaggtcaagaagaggagtggttttacttggcatgtgggtgatcctagtgaaaatgtaaaaatagagagaagaagaagaatttagaagctgaggcaagaggatcacttgagcccaggagttcgaaactgcagtgagctatgattgtgccactgcactccagcctgggcaacagagcaagaccatgtctctaaaaaaagaagaatttaaattttaaatagtatgatcattctgcccatgcccatgtttgccctcaatgaacacgttcactatgtgtgcatgaaatggcacatggaaatcctctaattcccttagtttctcttttgactctcatagtgacaacatctttttgtgctgaatattattctggttttgaaaggtgcacatgaggctgggcgcagtggctcatgcctgtaaacccaacacatagggaggccgaggcaggcggattgcctgaggtcaggagttggtgaccagcctggctaacatggtgaaacctcatctctactaaaaaatacgaatattagctgggtgtggttgcacatgtctgtaatcccagccactcgggaggctgaggcaggagaattgcttgaacccgggaggcagaggttgcagtgagctgagatcaccccgttgcactccaacctgggcaacaagaatgaaactccatttcaaaaaaaaaaaaaaaaagtacacatgatccgccatatgacatgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaaccaactgggttcttgagaagattaaatatggaactacaagtttattggaagaaaatccactcccattgtaggaaacaggagaggaaataattagtgttccggtcaattgagttgtgattcagggctagtttctaatcaatcaggaagccgcactgggatctgggatccatggatccggctcactggccaggcaggtggtaaaattaaaagattagcatttcaggtgctaagatgatacctattccaaagccccttttcctaaactaactacacactctccctttcatcttccactattaatatggtctttaaaggggtatttatcaatcttttaagccagtctgcatctgaacccttcttttgtgtatgtggaagaacagagtcaatcttctactataaataatgaaaatgacagatactcatttcacagcccacctgtagccagggcaggcacacaacccaagctctgacagttggtcatacttactcaagaccttgaatcagaaactagcggccaaggaagcagaaagcatagaatcaagagtgaccatagtaattatcagcaactactttccagaggcaagagaagagggtcttaatagcaataggcagagtccagcattagggcttcgtggaacaaggggtgatgtgtgtgtcccatggcagcttgggtggtggtgtcactggacaagccctgagttgcagttaggcattgtttcaggctgtatagactcttaatctggttcttcagtctcctcaaagattctatgagctccccaatatcctttgatgaattccttttcaggtaaaaatcatcatagttggtttttgttgctcaccatcgagaacgctgatggaaatagagttcttgaaattgatagtcaaatggaaatggtaaaaaataaattacttgacaaaagatgtatggttttatcatttcacagagattgatttcatagtggtaagatcttttaagatgttacaaatcactacctccttcatctaaatctctacttaattgaacagttcttaagtaaagaggatgaaggattatgttagacttaccatctttaaggaactggagatgttgggttgtggggtgggaagggaaaaagattcttcctatcaaacttagtgtctgatttactgaccactgtctctggaatgtgtgttggttttgcccttgatggttttctgaaaaatgaaaataatttctccatccaccttttgaagcagaaatgcggatttattacacagaacaaaagattagggtgtgatatcaaaacactgtatgtgacagtgaagatgacagaggtgccctccagcctcaggactgcctggctcttggcacctgaaacttcttttctataatagatgaagattttatcacttccctagtctacccagctgcctgcttctgagcatgtggtcgagctgaagggttgtcatttgtcactattagagaaatcacatatatcacatatagacctacctagtaagtttatgaaaagcaaattgctgcaaagcctgggttttctgagttccaaactttcacacaaatcatggtggcttgtagatgagcatgaaggctggatatgagcagcaccacggacagcgccaaaggcatggcgtgttgggattggcaaacatcagtgggcaagtgcaagtggacctccccatccctttgaataaggagaccccacagacacagataggagatgccaggatatagttttcagattgtattcttttagttggaaatgatgacagcaactcaattcaaagtaacttaggttaaaagaggcatttattggtgacataactgaaaaatccaggtgcagatctgactttaggcctggataaatgcagaggctcaagtgacgttatgagggcacattttatcaccctccctctaggctctgctttctctatattagattgcttcttttcatctggtgacccctggagtttctagacttccataataccacctgaacaaccccaatgtaaaatgcacttatccctttcctgattatgccagccaaagtgccagcactaatacttaacagctttgattggcccagattggatcacatgcccattcctgaatcaatcactgtgaccagcaggatggaatatttccattggctgggacaggcccacttgaccactgctggagccatgttacatggaagccatgttacacccatgttacatggaagaattgaaggagggtggttcttctaagaaatattagaatgctgtcatcacaaaacactagaatagacagaaccacagatgcccactacccaatcaagatgaccgaagggaaagatctgaattaaggaatagatccccctacctctcaggaaatcggatttccccatcttctattaggaccgatccatctctcagccttgctcactggtgcagaaatataaagcattgacattggagtaggtgtttagggaggaggaaagtgtgttgatattggagcaatcttgtgtgctaaagacctacaactgttccccaaaatatcaagctcttctcatcaacacagatgaaaataaaagagaatacagcacatatcctttaggttagagctcagatgtcaccgccttagacaggtcttttctgactgacaccctgcttaaagtgacttcctccaatcactatcttatgtcctctttattttcatcataccacttatcagaatctgtaataatcatgcttacagagtaattgttatctttttcccagcactgaaatttaatctgaagaacaggaggcttgcttatcttgtttactgctacatactatacctggctccaggcatagtgcctgtcacatagtaattgtgcaacattttttttttttcaagacggagtctcgctctgtcacccaggctggagtgcagtggcgtgatctcggctcactgcaacctctgcctcccaggttcaagctattctcctgcctcagcttcccgagtagctgggactacaggcgcccacgaccacgcccagctaatttttgtatttttactagagacggggtttcaccatattggccaggctggtcttgagctcctgaccttgtgatccacctgccttggcctcccgaagtgctggaatcgcaggcgtgagccaatgtgccctgccaaatgtattttgattcaaagaattgatggaaactcctgggtcatgtcctagaaggtggcccaagagatcagggaacacttagcattaaatatttctttcaatcagcttctttttttctttgtaatttttagagatattttaaaaaataataattttctgaaaaatgtatcttcttacaaaatataaggagtctttaagtggcaaaggaaaattcttggaattttcctggatccaagaagcgtcatggatgctctgccctttgcttaactttctgtggatctccgtcttttcagaagtgctgtctctttgtgtccttgtgagacacttggcacagttggctgtgtagaaaaagaaaagcacggaggcttgcggacctctttttatctccctgccagactgtaagctgttggaggtcaaaggctggtttctactgacctttgtgcccacacaacacctaacacagtgttttatgcataatgagtggctgttggttggcttgaaatgcatagcgtttaattaaatctctaaattcttgtgtctgccatagtgacctaaaacttgacaacgtgatgctcgattctgagggacacatcaagattgccgattttggcatgtgtaaggaaaacatctgggatggggtgacaaccaagacattctgtggcactccagactacatcgcccccgaggtgagagctgctgggcacacgttcacattgcggtgatgtaccctctgctccccagatggctgtgtgagagctgggaagggttgagggtggtaccttgcaagggaacctcggacagattcttattctatactctaaatcctccctttgagatcacacatgcaaattaatttagcacacatccagaagcccaagcccaaaatacatcaaggtttgggagaaaatttaaataaaacccaaaagaaccatccaacacacatcagtaaaattcttcgtcaaactgttgtggctcacggccatgtgataccgcctaattatgacattgaaatgtttgttgagagaaaaagagcatatcccctgggctggcatatgacatgggatctgtgtcctgtatatgtccctcagcaggaaaatggacaatagcccgtgatttatttatagcatgaaatactaccaggcaccaattcagaagagtgagttagatatatatgtagatgtgaaaagatcttcaagacacattgttagagaaaaaaatcaaggtacagaatgacaaatacaaggccaggtgtggcagctcgcgcctgtaatcccagcactttgggaggcagaggcaggtggatcacttgagcccaggagttccagaccagcctggccaacatggcgagacctcgtctctacaaaaaatacaaaaattagccgggtgtggtggcacatgcctgtagtcccagctacttgggaggctgaggtaagagaatcacctgagccccaggaggtccaggctgcagtgagccgtgattatgccactgcactccagcctgcctgggtgacacagtaagaccctgtctcaaaaaaaaaaaaaaaaaaaagaagaagaatgacaaataacactatgatactatttatggatgaaacagaaatacacagaacactgttctgttttcaatgagtaaaagcatacaaaaatctggaagatttcaaactgattttataacactggttacctctgaggataagggaattgtaaagagaaatttagctatttctgtatactgctgacattttttacaaggtaaatgtatttgggtattacttgagtaataaagtaattctttaaaaataataaggctttactcggacccagtgaagttttccctatgtgatatgctttggtctattatcattttgttaattaattagataggacacaatccataacacaacttcctgataggccaggggttccataatctctggttctcaactctaactgcagtttagagtcgtgagggagcttttacaatgtaggatgcagctggggcatggtggctcactcctgtaatctcagcactttgggagcctgaggcaagaagatcgcttgagggtagaagtttgagaccagactggacaacatagtgagaccctaatctctacaaaaaaaattaaaaattcgccaggtgcactaggtcacccctgctgtcctgactactcaggaggctaaggtgggaggatcacttgagcccagcaggtagaggctgcagtaagcagtgatcatgccactgcaccccaccctgggcgactgagcgagactctgtctcaaaaaaagaaagaaagaaagaaagaaagtgtttccacacttttaaagtacttcaagtcttatttgatcctcatgacaagccaacaagttaatccttttacaaaggaaactagagcctgggatgtgacagcagttgccgaaggtgatgtggttagctcatgacaaagcctgacctgctgcttatccctcccatctgtgggctggaggggaggcaacttcaccagccacacagttgagggtttcttgtgcttgcctgaatcacgaccagcgaggaacttctgagaaccacagatcctgggcctccacctgcagagattctaatgggatgatgcttgggcatcccacattgtttcttgtgtgtgtgtgtgtgtgtgtgtgtgtgtttgagacagggtctcactctgtctactcactgcaagctctgcctcctggattcatgccattctcctgcctcagcctcccgagtagctgggactacaggtgcccatcaccacgcccagctaattttttttgtatttttttagtagagacggggtttcaccgtgttagccaggatggtcgcgatctcctgacctcgtgatccgcccgcctcggcctcccaaagtggaaaacacgttcaatgagaagtgttctcctggaatgctttcccttccttgtcttgagggttacttctcagaatgcatttcattcattcataattgaccagtaaaattgtatacatttatcatgtgcaacatgttgttctgaaatatgcatacattgtggaatggctaagttgagttaattaacatatttattgtctcacatacttatttttttatggtaaaaacacttaaaaatccctcttagcaattttcaagaatacaatagattgttattaactatggttactgtgttacacgataagtctcttgaatttattcctgctacttaactgaaattttgtatcctgtaatcaacatctctgcatttctgattttggaatagaaatcaaagtgggagatagagatcaagaaacaaacattcactttatagccaagtttgctcaaataccctttttgagttaaacaagcaataactgaattataaaacattctaggattagttaacattttgagggcataatatgtgaaagccaccgagtatctcattcatcctcacataacttcatgatatagagattatagaagttaagtaacttctcctgtggtcagacagccaaccggtagacagcagtcaggattcaaagtcagactgcctaaccctcagacctcagcctttagcctttgctgtattacctcttaacctctgacatggttagttttacatccctgcatactgaaagatggacaatcacatagctcttctagacttttccatgttcttgcagtttgggaatatgaattaaaaacttcacaaccatatataccatatgatacaccaattctacatctaggagtttatcttaaggaaatacttggacagatgtccaaatgtctaattacaagaatatatgttacagcattggaagaaacctaatcaactggaaatttataagatagattttggtatatccattcaacggaatgctatgcacagataaaaattgattatgttcatatacaaatattaaattagcaaggaaaacttaagtgaataactggctttattaaagatctattgcccataatcccagtgctttgggaggccaagatgggagctttgcttgagtttgagatcagtctgggcaatatagagagaccccatccctacaaaaaattaaataattagcatggtggtgagcacctgtagtcccaactacacaggaggctgaggtgcgaggattgcttgagcccaggaggccaaggctgtgagctgtgagctatgatctcaccactgcactccagcctgggtgacaaaaagagacactatctcaaaaaaaaaagaaaagaaaaaaagaaaaaaaatcgtccaaatactaaagtgtttatgtaaagcacacacatacacacagagtttaatatgtattcagagaaaagagtatggaatgaagtagaccaaatattagtcataatttttctcttaataaaggattatgggtgattttcatgttattatctcagctgagctatcttttataaagaaatattaaaatagtgacaaatgttgttatctcttaaacgtttttatgtttaattatgttttaaaaacatgtaacgtaaaatttactattttaaccagttctaagtatacaatttagtagtgttaagtatatttacattattgtgtaaatgttgtaacttttacagaggagtaaagacagtttttccttttaaaaattccatgctcactgttttgaaaataataataacaatacaccttacttagtgcttcgaaaaggcaatgtgacagccacaggtgtttgcccagctgcaggtgcctctgcaaagcatgtctgtcattccctgaatagctaatataaagaaacagttcaggtgggcactggccttcttgtaaaagaagagtgaaatctgtctccagaagaaacatgaactgcaaacctccctgatagggtgccttctcttttctagataattgcttatcagccctatgggaagtccgtggattggtgggcatttggagtcctgctgtatgaaatgttggctgggcaggtaattgaattttaagtgatcgataagagaagtcctccctacccccatccacatggtttctttaggagaatgcatgtttggtaacagctcataaattggaacctctatgactttcccggccttggggtcatacaagtctgtggtcatttgaaagcctgggtgtgtggcttcactgtgggccccagggaggagggtctgccagttgaggggagctagggggagggttcaagcagggattcttctcctcccaccctcccctgtcatacaggcaccctttgaaggggaggatgaagatgaactcttccaatccatcatggaacacaacgtagcctatcccaagtctatgtccaaggaagctgtggccatctgcaaaggggtaagtgcatctcttaaagctgtgaccaggaccaccacataaaggcatgtgggctgtaccttgcccaagaacaccccaccaggggggaacacagcctgaactccacccttcactccatttgccaatatgagaaccctgatgtggagctgctacctcccggaggagagagagctttttttctgatttgcacagaagtgctgtagagagctgcctgcagctgcgtcttgctgctggctgggctgcagtctctgaaccagcacaggggaatgcttattgaatgaatgaggtagaaagcacagagattttgtcaaagagctggaagtcatgggaaagggcacaagaggtcttttgcacaactcaggctatcttgccctgctctgctgtatgtgtttagttaatactaagagcgtgcaacttttgttctaaaaaataccacgccgtgttgaggttaaggaattctctagataagcagactgaaattcaatgtactcaaaatcccactgtctcctctccccagacacacacacaaatggctaaaagggcatgcacgcttggacatctacggtttatgcacagggcacctgtgaagaaagcaggatgtgtgtttatggggaaggattgtttgttttgcatcttgtgttggaccagggcatactcacagtgacttctgtgagatcctaaagatcagcgaccctcacctttggagccatcagaataacccgaagtgccttaccagaatgcacatgcttctgccttaccccagagattaagtctgggtatgagtattttggaaaagtctccatttggcttgcagaccactgcctttaaaaatactgtccaaatgaagtgatttttcaactctgatggaagcctgaaagcaatagaattagacgcccagaaaatatgttctacacataatatactaataaaggatttgctctccctccacccagtggtacaggttagaacatggccgtgccttaatcagtgggttcccacctgtgtgtctgaataaaccagggctgccagtcctagatctgtgggatgcttgcagacttttcatgccctactttgttcttcctgaccccagccagatgctggatgcactgtcttgggtgaaggaaagctgggaaactcaggcaggccaatctgaggcttggcccagtttggaatagctgggccagcctctcagcctaaaagcgccttgtcacactgcctaaattcccactctcaatgaatcacctaaggtttgcacctcagctgcataggctaagatgcatgtatccctggggaaaccacctgtgaattagtctcaatcccgaacatctaaagtgaattgcttgaaaatattttctttgagggtgtgaggcagggagaaagaaagtgaagaatagagaggggagtcccagaggtgcattaggaacccaagcaaagcccataaagaaaaaaaaggcacacacgaaggcctccacaggcccccgtagacaagttattgaagggtgggggcgggtagagagaaggtggtacctggagcttttagtttgtttaataattaccagcatataaggatccagagatttctcaaaaacattcagctttcaggtttctcttgaaaaatcagatcttgccacattggcctgtcattcttacaaagcaccagtcagctggattggaaaccatggccctctgtagttggagcttgccctctgtaattctcagacgttctcatttggccaattctctccaagttcaaatcctggttcaggcattaattgccgcaggaccttggggaagttgtttgacggcatctgcagattggggataataatagcactccacattgggttctttgatgactaaacagctgaatactgtaaatcacttagaatagaggctggcactctgctccaagccccttggaagttattattactattactagtgctgacgctattgtgttatctgccaggttcctcttggcatttgagtttgcatcccctggaattgcaacttttaaagtaggggattttggagatcaagggaccctttgcaaatcttgacccttctactttctaggcacaaggtgtttttgttttgttttgttttgttttgttttgttttgttttgttttatcaatgtctcgctctgtcgcccaggctagagtgccgtggagtgatcatggctcactgcagccttgatctcccaggctcaagggatcctcctgcctctgcctcccaaagtgctgggattacaggcatgggccactgcacccagcctaggtgcaagatcttaagccacttcctttgcatctctgggcttctgtttattttaaaaaatggaatagtagtactcattgaaaagagtttttgagagcattaaatgagataacataagagaaagctccttgcatgatgtgggcacatagtaggtgtttaatacatccacagggtcctccccttcacacgcccgccctgcctggacagctgggggttctaaatgggtcatggaggaaagagcattttccaggtcagctgccttcagctcctgctccaattagcagtttccctggtagagccgttttctattaattcaggacccataaccttcatgattaactggggtgactctcttactattgagtttggggaccattattaattgagtgggctgagtccaatggggctcttccttcaaggagggtactccaaaaacgagtgatgctcaagcaaacagccaaatgcttcctctggaacagcgagccccaggggatacgtctgggaggtgatcagagattggaacagtgattaaatccagctgtctacatggcttcgggcacattagagcagagtgcgggaactgggcagagactccgaattaatgctggatgtttttgcagtaccttttctttgcttggcatcctcctgcttagacagaaattcagttgagcttttgaaaacagtcacctgtttaattgaagcagtgtcctttatatgtccattcccttaaaggcccgattttctactaaaaaaaaaaaattagtaaaaccttactcagatggctattcccactttgaacaaacttgaagcaaacagaagcccaaatagacaggaccttagggtgaaaaccagcagacactgaacagctgagactgaacataaagctataagagtcctgagccaggcagagctgttcaaagccttgccctgctccttagctgtttgaccttaggcagatgactttacttctctgcacccacatcctttacctggaaaatgggggataatagttgctgaggccttagagtattgttgcaaagtttaaagagtaatgggtaatggccgggaagcctttagcacggagcctgaacgcatatgatgttgtcatactcagtacacggaagccgttattgatgttattatcagtgtgaaccaaaacctcactgccctttctttcctcccatcctaatcttacacaaatgtcaagccttggctcaatttcctcaccctccataaacctctcctgacaaagccaggccacaaaaattcctgagaaaaccacgtgtgaaatgcactcccatttttcttaaaagcccaagttttagagctaggcagaggtggagtctgcacccagctcttactgactctaccacttcctctctggagtccttactgttcctcaacttctctgagtgttcattgcctttttattcaaatgggaaaaatagtatactcacctcattgggttattatgatgatcagggaagctcatgcatgtaaataaagaagtagcagctcggcgcggtggctcttgcctgtaatcccagcactttgggaggctgaggcaggcagatcatgaggtcaggagatcgagaccatcctggctaacatggtgaaaccccgtctctactaaaaatacaagaaaattattagctgggcatggtggtgggcgcctgtaatcccagctactcgggaggctgaggcaggagaatggcgtgaacccgggaggtggagcttgcagtgacccgagatcgcgcctctgcactccagcctgggtgacagagtgagactccgtctcaaaaaaaaaaaaaaaaaaaaagaagtagctagcttagaatgtaagtgctcagttaatttccccaccctggaggatacactttatatgacaagtacatgcttgtgtgtgagaccacaaattatcttgcgagggggcaacaggctgagtgactgtccaacagtgtaggaatgaatttctgggttcattccttccccatcatcagcaagtcctgggcagaagattctgccatcatgggcttctcaatgtgatgtcaactctggaaagcttttggacttgtatgcttctttctttttttttaattaatcaccaactcttctgtctttactccctgtgcatttgctcaagtcttgagatcagagatattttcatgctgctttggactcatttacaagaggaagcctgtctggtttcatcttggcgcatctattcatcttgttatttagcactcagagacccaaagatggagggttttgataattaagtaatttaaacggaacaccaaagaaacctcagcggctttgtgtgtaatgtatgatacaagggaaatgagctgggctaggttttgactatttaatgggctttcagaaagtaattacttgaaacttgggcccctttgactaatactttttcttctgttttgtcatttttgcaagtgctttactgagaaatgcaaatggtatctgaatgaatgtagcctttgcttttgtcaaactccagttttcttgttgtgggaggagggaagtttgaagatattgaaactgtcctaattaaatgcactggtaattgcacaaaacttattcttaaaccaaaatggataaatggatcatgtggcatttatttttttctttctgtttttttttttttggttgtttttttggttttgttttttttttttgagatggagtctctctctgtcgccagactgtagagtgcagtggcgcgatctcagctcactgcaacctccgcttcccgggttcaacaattctcctgcctcagcctcccaagtagctgggactacaggtgtgtgccaccatacccagctaatttttgtatttttagtagagacagggtttcaccatgttggccaggatggtctcaatctcttgaccttgtgattcgcccgcctaggcctcccaaagtgctgggattacaggtgtgagccactgtgcctggccctcatgtggcatttctaacttgaagttcacggccacattcaggcttcgttttgattaaccataacagatgattggcagtgggtcctattatcaggtcctctcctgcaaattcctggctgggattttttgctgggataaaaagcaaaaaacaaaaatgagttgagattcttcatttgcgctttctttcctaatgcattggagtaataatttctgagtgtcttacatttcctcttctgaaactcagcaaattcaatgtttttctttctctcgaagctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcatgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcttcgattcaattattgtaactgtcttagctgacaactttctgagaatggttcttgggtgagcagagttcagatccatttttggactgtgataaaggatctaattttgccctcattctttctcttggttcaactgtgtcattttttcttcatactgacattgaaaaggtcatgttgtttatctcaacagtatttaaatttaattctgaaacatacactatgtctgagtcagtaaataagatggcagttcagcagccagctcccacccaaggcaaaacagagtgaagcagagactgaagtcctcttgaactgaagaccccctccgggagggtttgggtgtggagatggctttgacataagttttataatgcaagaataaaactctcacatttcccacagtccatgtaccaacaggaaggttttctatccccaaagactcagcaggaagtacttgtcggcatcaggaaagaagagtttacacctgaattaatcaaactgttattctgctgggaggatatttccttgtgaaattaaatagagggcagacttggtgactcaatgatgggttgtaaaactactgactgaggctgaagagtgaacataaacaccatcattgaaacctaacgttgtaagggtttgagtgttaagatgaagaagataataatggtagttattttgatactagtattgttattcatttcttgagcacttacgtgctaggcacgtaatgataatagttttgacatcagagggttgttatgatgcataaagcactttgtacaagcctggtacagaggaggcactcacagagagctgatcatggttttcgttagctgtgtcatacattaattaatgtcccggtgtagagtctttgaggggcagaatcctgctgctgctattccttaagataacatctgtgtgtacattggggtcgaagagggccccacatgtcatgagcagcatcacagcttttatgggaccatttggaaaaagatgaaaaggtaacctggaaaggaagagtgagctctttgttcaggaaacagggaactcagaggtgagatgcataactcatatggtttttgtggggttatttatgagatcttgaaatgtggacctccctttcctctcttggccagatgcacacgctcccatccccaccagcatagaacccagcggacatctgggggtcatgttatagctgtagtgcagtggtttgcaaagtgtgctgtctatcagtatgcagtatcagtatgcagtgtcagagccagcggtattgacatctcctgagcactttaggaatgaagttcttggtctccaccccagacctcctgaatcagacactctaggtgtggggcccagtgttctgtgtttaataggctctccaggtgacttgatgagctctcaaggttgagaatcactgctgtggagtttggcattaggagctcagccagggaagctaggcagagaccagagggaggtagcatggagaatcatctccttttttttctttttttaaagacagggtcttcttctgttacccaggttggagtgcagtagcgcgatcatagcttactgcaacctcgacctccagggctcatgcgatgctctcacctcagcctcctgagtagctgggactacaggagtgtaccaccatgtctgcctaattttttatttttatttttaaataaatggggtcttggccgggtgcggtgcctcacgcctataatctcagcactttgggaagccgaggtgggtggatcacctgagctcaggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccatctcaaataaataaataaataaataaataaataaataaataaataaataaataaataaatgtggtcttgccatgttgcccaggctagtctcaaattcctgggctcaagtgatcctccaaaaacctcagcctcccaaagtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagtgttggagatcgatgcaagccagagagcaggtgatctacctaacaggctcagctgatgttcacctcccgatggcctgccccgcaggatgcagcctcctcagggctgctccatcttcatggtatttggggctagaactcggtgctgtgggatgcagcagacctgtgagttgattgacagatcctgttacagtcagtgtagtatgtaggccctgtgtagtaagggcttagtgaaagggtgtataaagttaagatgtttatataaaatctcacaattttggctgggtatagtggctcacacccgtaatcccagcactttgggaggctgagccgggcagatcacctgaggtcaggagttcgagaccagcctggccaacatagtgaaaccccatctgtactaaaaatacaaaaattagctagatgcgatggcatgcacctgtagtcccaactacttgggaggctgaggatagagaatcgcttgaacctggaggcagaggttgcagtgagctgagattgtgccattgcactctagcctgggtgacagagcaagactccgtctcaaaaacaaacaaacaaacaaaaaaacaaaaaacaacaaaaaaaaaacctcacaatttcttttatatatcagaacaaatttttgaaaattaaacacagtttggggcaaataaaacacacccacacccatatgtatcccatgcattgttggtttatagcctcaggggtagtgatggttcaaagtcaggttgctatttagccagcatctgttagcaatggttatttacaaccagagtccattttgaccggttaaatattttgaatagccctgctaagcagtaatgaatataagaggtctagcctcgtgcctggctcatagaaagcactcaggaaaaggtagctgttattatcattgataatataaaaagattacaatacttagtcattatcaacgagatccctcaactgttctgcatttgatatgatttcccactgacctgtgtcttgaattcctccatgtgggtttaacaatgactttcaaagtacagtgatcaggctgtgctacatacttcaaagtgttctggtaccagctctaaaggagcaggtgctaccttcagtctccttagactgaattagaaataataataaatgatacattatccaggtacagtggctcatgcctgtaatccccacactttggaaggctgaggcaggcaaattgcttgagcccaggaatttgagaccagtctgggcaacatggcaaaaccccgtctctacaaaaaatacaaacgttggtgggcgtgatagcatccacctgtagtcccagctactcaggaggctgaggtgggaggatcttgatcctgggaggttgaggctgcagtgagccatgatcatgccactgcactctagcctgggcaacagagcaagaccctgtctcagaaaaaaaaaaaaagatacatcacctacccatttgatccagcctgcctgtatgccttttacattgcaaatgcattgcatgagagccctcctccccccaatcccaggattttatatttctccttcctcaccccttcttaactgtctgccacttccaaaaggcccatggtgagcgtgtgcagagttccatgtgccttgtgggatgtgaaaaggcatgcatgtatctgtcagcgtttctgattcatgcatgctattaaatagagtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcagagatcttaataaaaatatcaacctacatttatatactgacaaacaaatagccaagagccatttaggacacacagcttggagtctgtttatctctctccacctatctacacacccatggagaacccatttaaacttcagatcaaaccaggctccctttagatggttggaattgtcaggttcctgagccaggtgaagttcctaaatcagtttctgtcttagtccatgttgtgttgctatgactgaataccacagactagataatttataaagaaaagaaatttatttcttacagttctggaggctgggaagtccaagggtgaggggcttgcatctggtgagagacttcttgctgtgtcatcccatggcagaaggtgaagggcaagagagagtatgcgtgcatgtgtgtgcatatatatgcatatgcatacatgtgtgtgcacatgcaggggaaagatacggagccaaactcatcccttttattaggatcccactaccaagataatgttgttaagttctcatgaggtgccacctctcaacactgttgcattggagattcagtttctaacacatgaactttggcggggcaagtcaaccatagaacctaccagatacatgactttgagtcatgtactattatattattatttattattattattgttattttgatactggtccatggcccagggattggggatccctgccctaaatcgtgaggaagattgaggcccatgggtgccactggttggtagccgtcagcttcttaccacctaccggcacctccatagtcatcttgacctccttgcccagcttccatctctgtcttagcaaatatgttttccctcccccaactcatgtgagacttaccctcactcctgctctggactccagcctcttgatccttcatgcttatctcccctgtttagtctgtctacagcttctctctgtatcaacaaaactcctatggtttcaaataggaatctgatttaaactgacttttaagcaaaaaataatgatagttagtattcagatgtagatggatcatctacatctggtcccaaacaatgccagcagggaaacatttatctatatcccttaggattactttccccactgtgttgacttcattcttcattctcagaaggctttcttgggcacatagcaactcccaatttatgtcccattatctctgcaacttctaccaaagaaaagggcttcctttttataaaatcccagcagcctaggactcaatctttttggaagattattgggtcatatgcccatctctaagggaattgctcactgcaccagggggatggaatgtgctgattgaccgggcctgggtcaccagcccctcttagccagagagctggatctaatccagacattttgaaaaaagagaaggaatgtcctatctaaatcagacattttgaaagaagagaaggaatatctcctttaagaaaaaaaagccactgtcatggccgggtgtggtggctcacgcctataatcccagcactttgggaggctgaggcgggtggatcatgaggtcaggagatcgagaccatcttggctaacacggtgaaaccccatctccactaaaaaatacaaaaaattagctgggcgcggtggcgggcacctgtagtcccagctactcgggaggctgaggcaggagaatggcgtgaacccaggaggcggagcttgcagtgagctgagatagcgccactgcagtccagcctgggcaaaagagcgagactccgtctcaaaaaaaaaaaaaaagaaaaaaagaaaaataaagccactgtcactagaagaaaagacaatgcctgctggctgggcaaaaacagcagctgtcctttctgactctatcctggccttctcctttgtgcataaacctgctatgtctttttcatgttaaaaatcccctacctcaaacctgggaatcctccttactactactcttactactgctatgattactaccctaccttactttgcatacaaacacacttttgaaagagttgccagttcctgctatttccacttgatgacaatttattgtttcctcagtttggtgcaatctggcttctgctcccgccatcctattgatatttttctcattgagtcatcaatgacctgaaaactgcctcttctcataagcttgtctcatctttcttgacctcaccatattattaggtgctctaatcctttctcctttaaaaaaatgtgaaaaaataaaatattcaagcagcatcagaagctacaaagtgaaattaagattcccctcacccatggctcctagctaggcttcctggttctccttcccagagacacccattgcaaccaggttcttgtgtgaccttctagagaagatgtgttcaggcccagaaatagtctacatcacacacaaggatgttagcatgctgtgtacaatttctgtatcttgcattattcccctctgtcttggagattgtttcttatctgcttatctaactctacatcaccctttgaataacttcctagtttcctatataagtgagtttatctgtaggaaaagttcagagtgccttctttctttttaagcccctcttctccttcatttttatgacattgtgtgtctgtcttagtctgttttgtgctgctataagaatacctgaaactggggcctggtgcagtggctcatgcctgtaattccagcactttgggaggttaacatgggcagatcacttgagcttgagcccaggagtttgagaccagcttggggaacatggcaaaatctgtctttacacacacaaaaattacaaaaatcaaccaggtggggtggcacatgcctgtagtcccagctacttgggtgactaaggcaggattgcttgagcctgggaggtcaaggctgcagtgtcgtggtcacagcttgctgcagactcgacctcccaggcttaagcaatcctcctgctcgagtgacagagtgagaccctgtctcaaaaaaaaaaaagtggataacttacaatgaaaagaaatttatttggctcatggttctggagggtgggaagtacaagatcaggggctgtatctggggaggaccttcttgctgcatagtaacctgatagaaggcatcacatggcaagagaacacatgagggagggtaacttactttttaaataaattcactcccacaataataacatcaatccagtcacctccaaaagttcccacctctcaacactgttgcattggggattaagtgtccagcacaagaactttgggagaacacattcaaaccatatcaccacatttgctgatgttcttcctaccttcacagccactcccaatagaaattccaactccacaaagacttccagtgacagttgaatttggagggttgagaccagctcatgacccagaaaggaaaacagaaagcttactttttgttttgttacaagtgcagtctcttaaaaataaccacaaaatgcccccccaaatggcatatggaaaacagcacagagatggtgtgttaatctacctgaaatgtctttctaaggaagtgaggcttggatgggaacggaaatgcatccctttttcttcccagggtacacgtctttttctcacttcctctaactgggagccccagggcctggctttgtcttgtagcttcctgccgtgatgcaccaggctaagtgggaaggtttctgttctatgtctaaagtagcactggcaggtcctcattctgcttgtaattgggatgggaatatgggtaggaatttagggtttggcagagcgtacaggacctctttcaagccagagcacagccctgtcagacttactcactggacatgaatgggtcagtcagccctcagcagtaaccaccagctaccatgttaagtatttgatgtgaattttatcaagtcattctcgccacaccctacaagaaacttgagcttaggggacttagctaacttgcttgaaggttgtatagctgggaattgttggagccaggattggtacccaggttagcttaacttttaagtccgtgccacacaatcagatacatagtatgaggcaatgggatgtaatggaaagcccatgggctttggaattgaacagatgggctctggatcttggctctcctacttgaccctatatgaccctgaacaaactgttaactcttaaaattatctgttaagtagagataatccttttcctgcctatctcacagccttgtgggaatcaaagctataaaaagataggcaaatagaagggataattactatttgagggtgagtttacttgaagccaacaatgtgggtttaggatgaatggtgaagaatagataagaaaaaaaatgatattctgttgacatgggaagatgtttagagtgtatttcatctagtttcttttaaaaagcaagcaaaagaacagagtcatgattccacctttgtctaaaaactaaaaaacatccattcatctattcatccagccatctaggatacaaaccaagatgttaacataatacagagatttggggtggcgggattaagaaggattcttttgtgtgttttaaaattttttatggccaggcacagaggctcatgcctgtaatcctagcactttgggaggccaaggcgtgcagatcacgaggtcaggagttcgagaccagcctagccaacatagtgaaaccccgtctctactaaaaatacaaaaattagctgggcatggtgatgggtgcctgtagtcccagctacttgggaggctgaggcaggagaatcgcttgaacccgggaggtggaggttgcagtgagccgagatcgtgccactgcacaccagcctgggcgacaaagtgagacttcatctcaaaaaaaaaattattattataattccttttttttttttttttttttttagagacagggtcttactctgttacccaggctgaagtgaagtggaacagtcatagctcactgcagcctccagttcctgggctcaagggattccccgtgcctcagcctcttgaacagctgggaccacaggcatgcaccaccatgcctggccaatttttaaaaaattctttgtagagacaggttctctctatgttgcccaggctggtctcaaactcctgatctcaagtgatccttccacctgggcctcccaaagtgctggtattataggcatggcaccaccatgcctggcatcttggtgctttttaatagcttgtttgtttctgcgataaatgtaggagactgatagaagagtctggatctcttgtcaaatctaggatcaaatcgtggtcagatacttaaactaaacccattttctcattgcacagcaaggacttcatagagcttttggggggattaaaggaggtaaagcttgcaaaacacttaacacagtatctggctcatagttagtgcttaacatacactattatttgtccatttgattttttttcatccctgggttctagaaacgcagtggtgaataaaacagatgtgattttgctctcatgtggcttacagtctagatgagaacatagacaatcaacagagaatgaacatgtattaataattatagactgagatataccagattttatttctgttaaagaaatgaacaggatatcttgacagagaataacaggagggaagaatgagaatcctctttatttgaaggtggtctggaacagcttctctgacagggtgccatttaaactgagatctggaggaaatcaaaacactggatgttattttttaatgaaaattaagaaaagcaagagcaaaacaaaacagacttagtatcaaacacaaaagacccctctcctactgacttcctccctaaataaacataagagataaaagatccctgattgtaagggaccttcattattagcagaaaaaggagacttaaatctctctttttttctgccaaaacccagaccacaaatgactttttaaaatgatcaaatatgtatgcagctttgagcatctgattctccctggagtgggtccctcctgtattcggctgtgggaaactggaaggcataggaacgaccctgcatttcactggatgtgcacatgtgaaaaagaaagatgcgcttgtctttttgcctaggctatgtagcttggatgtcttttcatcgtgaccttctggtcttgttaacctgaaggtgtcctggtgtcttgatggaggctgggcaggtagctcccctgagccactagcctcatgttatcaaagtcggctaggcaacagacagcagggaggagccttatcctctcctccaccatcttaccttgtccatgccctctttttacctccatttcttctccaggctctttcctttcctcctccaaagaagcaatgtctctcttgcaggtcccactcaagtgagatgtcactccctccagacagagttcctggcccttcttgggttcctttcctctgtgctcaatggcagcacctgtcccatggtcccatgcagtggcctgtgtgtgcatctgtgtcctctgctagatcttaagctcaacggggacaagaacaggtaccctcttatgtatcgccagagtccagcatgctgctcggcagaggatctacaacagccaaatattagccttccttattatcccttagcaccaaaatacacgtcaaagcagccacttgttttagagtttttttgcttcattttgttttgagacagggtctcactctgtcacccaggctgaagtgcagaggcacgatcatagcttgctgcagtctaaacctcctgggctcaagtaatcctccaacttcagccttccaagtagctgggactacaggcatgtggcgtcatgccctgagaagttttaaatttttgtagagacagggtcttgctatgttgcccaggctggtctcacactcctagcctcaagcgatcctcctgctgccttagagtgttttactaagatgaagcatgttaaagtagcatcaggctaaccttaacaatttacccaaatactcccattctctttatttctatttttcaatttcttccatgataattgctgtctcatttaaaatagctttcacagcttcttttcttattacaaaataataataacaatacctgattgttatgtaaatttttaaaatataatcaagcataaaggggaaaaggaaaaaattaaaaccatctgtaattcttcgaatctccataagcctgtgtataaaatgtgtacagatattacgtatacatttgtgtatataatttatagaatgggaagatattgtacacactgttagtaattatataactatgtcatttaatattcttctacatcttcttttaatttttaagaatgttttgcatggtaatacatcaaatagatgtatcattatttatttaactgttttccctattggcccatagtagattcccaatttttctttcctctgacgattctttgatgaacaccctgtattttgatggggtaaatccaggagtatagaggacaggtcagggaaaacctcgtggaggaagtgacactgctctggagacagaaaggatgcacaggagatagctggatgagtggagaaggagtggaaggcaagtgttcctggcagaggaggcagcctgtgcaagggcctggagtcacctccaagagttcatgagtgttctaggaactggaaatacttcagtatggctggagggtgtctcagggggtgggggacacaggcagggaaggggccattgaccaagtgtccaggaacaggtcctaaatggccccttaagccatgctaaggagtgtgggctttgggcaatggggagctattgcagataagagcagggaaatggcatactccagtcagcgtctttaaaagatccctttagctggccatggtggtgtgcagctgtggtcccaagctactcacaaggccaaggcaagaggatcccttgagccttggaattcaaggtggcagtgagctatgatcacgccactgcaccccaacctgggtaagagagcaagaccttgtctcaaaaaacaaaacaaaacaaaacaaaaaagagatccctgtggcagtggtgaccaagccaactccacattcaacagcaagactctgttattaattcaatgaaacagaaattaaaagagaagagaaaaagaaaaagagcttacgtgtaacaggtcacagataagcttttcaaactgtctagattcttaaattcaggagcgtaattcaacaaatcaaccttcttactcctctccttaatcctgaaagaggtgcttgtggtttaaataacccagttggtttctggcccccattcctgttccaggagccccattgatgtaccctgatgacaagggagtcggattttctttttttttttaagctgagtgaggctgaagtgttcacccaagacaagccagagaggcaggtgcaatccatggtgcgtttttaattagatcccagccactgagctgcccatacttcaaggacacagcaggcaggaaactgatctgggctgtgtctcccaagggctgacgtctccatttagggagcgctcctgaagctaatggtcagtgacagctccatttgaaaaacacagaaacacttaacagggaggctgtgatctgccagccctgtaagctgctgattagcagggaaatcacgctccctctgtatcgcacccccttggttaatccctgttcttgtgtctcctctgtgctatctcacttaaagatttcattgttctctgaggcaggagggagtggggagagggagggggaggttgtggagctgccagaagctgtttcactgtctcccatcacagcctctggggaggcccaggcgaagaaacagccttctggtgtggatgggaaattgatggtttttaaagaaaaatggtccctgaagatgctctgtgtctcagcaaatgtgcttcctagactggctggcttgggttccaacacccaggccaaagaaaaacacgcacgggtctgccttatagtcacaccaggatgccataccagcagtccctgccaccatcacctctttgttgtctgctctgcctcccctttctacagtcctaagccaccattcctctcctgtggatgactgcggcagtctctccccgatgccacggccaccaatctagctccccaaacctctgcaatccccacactgcagctgaggggactccttgacgtgtcctctggaattttgaacttatcaaaaaggaaagcaaatactaaatttcccccctcaaataggatctcctcctcgtgttcctctcttactaaatagctcaggccaaaaatgccagggtcaccaacaatgcctctcttcctcacataccccacacccaatccatcagcaaatcttgtcaactctgaattcagaatataccccacatccgaatgcatctttccatccctccaccaatcaccttccttcaagcccccatcattcttaactggattatcataaccacctcctcactggttgtactgtttccactattgtcccccgctcatttaatctatccttgtacaccacaccagtgatcctgtttaaatgtaaatcagggccagtcttggtggctgacacctggaattccagaactttgggaggctgaggtgggaggatcacttgaggataggagttcgagaccagcctgggcaacatagcaagaccccacacacacaccctgtgtctacaaaaaaaaaaaaattagtcctgcgtggtggtgcacacctgtagtcctagctactcatgaggctaaagtgggaggattgcttgagcccaggagtttgaggctgcagtgagctgtgatcatgcctctgactcaagcatgggcaacagagcaagaccatgtctctaaaacaatgaaatattataaaaacaaaacatacgtcatcatatcattcagggctcaacattctccagcagtttctcatctagctgagatgaaaatccactgtccttacatggccatcaaggaccctgctctggctcgtggcccgctgtgtggccccttggtcactctgctctggccataccatactgacctcattgctgcttggtgactgtgccaggtgagctctgtcttggggcctttgcacttgctgctccctctgcctagcatgcctttcctcccgacatccaaagggcaccctctctcacttcactgaggtcttgctcaaaggccatttcctccaagctgaaaatggcatcactctcactccatcccctggactttcttcttcttttttttttttttgagacagagtctcattctgtcgcccaggctggagtgcagtggcttgatctccgctcactgcaacctctgcctcctgggctcaagtgatccccccaccacagtcctcctgagtagctgggaccacaggtgtgcaccaccacacccagctaatatttgtatttttggtagagacggggtttcaccatgttgcccaggctggtcatgaattcctgagctcaagtgatccaccatcctcggcctctcaaagtgctgggattataggcgtgagctaccctgcccggccttggctttatttttcttcacatcacttatctccctctggcactaaaacatatattcacatttacagttacagtctcgtttgttgcttctcttccccagtaaaatgtaagttccatgaagcatggattttgtatcattttctactagcacagagcctggcatgtagtgggtgctcagtaaatccgtcttgaatgagaaaatgaataaacaaatgaatgaatctggacaacaattctaaccacagtgagtttaccgaggggtcatccttctgtgggagcttccctccactggccagcagaaaagaccccaggtcttcatactatgtcagagagttctcattttctgagacctgaagccaagataacaaaaacagcagaaacaatttagcttggaatgacaaataggtttccttaagtctgacaagagtcttttaaaaattcaagactgtttccttagtatttaaaacttaaacaccatgcaaatgccctattataggaaacatacgctgtctgtctgtagggatttgtagtagaaaatgggaactaaataatacttggagccatgatgcgttgatcacatactcagtacctgttacttgcattctctcattttatcctcatatcacaaccccagtgtgataggaattaaaattgctcccattttacaaaagaggaaactgaaactttaaggaacttgcccagagttgcacagatagtgggtagcataatgccagggtttgaattcagtctacagactcacttttttttttttttttttgcgatggagtttcccttttgttgcccaggctggagtgcaatggtgccatctcagctcactgtaacctctgcctcctgggtttaagtgattctcctgcctcagcctcccgagtagctgggattacaggcacctgacaccacgcctggctaattttttgtatttttagtagagatgggatttcaccatgttggccaggctggtctcgaactcttgatctcaggtgatccacccgcctcggcttcccaaagttcagggattacaggcatgagccaccgcgcccggccccagactcacttttactcagataagaagtgagcaggaggcagaggctcttggagacctaagtcccttgcatgcacagcaaatacttctgcttccctcaacaaaaaggctttgaagaagagcgtgcacctcttgactttctcaatgtaccttcactcctccagcaactgaagttcagtggcagccctccatttctcatcagtatcaccccagttgccaattgcaatgatcctttttcggcaactctcctatttgacctctgaaagatattttagttataccaatgcccttcacctggggtttctcccagtccttagcttggctgatactgttctctcctggttctcctcctgctgtcctaagacactttaaggagcatttttatcatgggcaaatggaaataaaacacctatttcacagagtttttacatgaatgaaaaaggtcatatattcaaaaacacttggcaaatgtctgtttcattgaaagtgctcactggtttttattactcttgttatctctttccactccccatattctgtgctttaaaaaaaaaaaaaaaaaaaaggtttttcaagacctctctcctcctgtgcttttttttccttttttttttttttttttttttttttcctttttggagtcaaggtctcaatcactgcccaggctggagtgcagtggtacaatccctgctcactgcaacctctacctcgctggctcaagcaattctctcacctcagtttcctgagtagctgggactacaggcatgcaccaccatgcccagctaattttttaaagacagggttttgccatgttggtcaggctggtctcaaactcatgacctcaggtgatctgcccacctcggcctcccaaagtgctgggattacaggtgtgaaccaccacgcctggcccagaacctgtgcttctgactccctctggtcatcaccaggactctcattggcctctcaaagtcgttatccaaaatggaattaatcatctttctcagttttcacactttctctgtctcagttcatacaaccacagtctctgtcattcaaaccagagacttcatcatccccatccttgtcttcccgctggccccttccccacttcattagttagtcagccaccaggctgccaccgtacttgtatatttatttatttatttatttatttatttatttatttatttattttgagagagagtctcgctctgtcacccaggctggagtgcagtggcgcgatctcagccgactgcaacctccgcctcccgggttcaagctattctcctgcttcagcctcctgagtagctgggactacaggtgcccatcaccacgcctggctaatttttatatttttagtagagacggggtttcatcatgttggctaggatggtctcgatctcctgactttgtgatccacccgcctcctcctcccaaagtgctgggattacaggcgtgagccactgcgcccagtcactgtacttgtaaaaatggagccaggaacttgggctctgatgtcagatggacctggttcatcttgctctgctattggtttgctgagattatgaacaaattacatagtctccgtggtctcagttccgtcatctataaaatggagatcataataatgcccacttcatagggccattgggaagattaaataaggtaatgcaagtaaagaactttccagtaaacagcattttgcactggtatatagcaaatgcataataaatatcagcagtcataattgttattactcctactactattatactattaggttgtggttacctcgtagagatactgtgttgaaaacacatagagcttttgtgcaaatgggttttgctggcaaagaacaaggaaccccaaattagcggtttgccccttctcattaggtgggaattagcatgtacaggtgtgagcacccatgcatgcatgcacacatttgcagacatgtacatacacatatgtgttataactctgcctcagatgggggcctttttaatatagaaacaccagcaggatgggtgagaaatggcaatggttttctctctagaacctgattgcttcaccaaacaatggtttgtatttcctcccacatccctccttcctaattgaagagggaatggctgaatttacctcctggcaccttgcatttgatgttcagtgactgatccagctaaccaggggcctcgtggttgcccaggcgttgcaagcatcaaacccagatcttcactgggatcttcctccagtggctggagtttataaattgtattctgttgagttggaaaacatccactgctcctgattgagagctggaggacagcactttgaggggtctgctgctataaatactgggatctcccaggtgatgtataaatgggtcactactttgcatcttgcaccacctgaaacatctcaggtgccttaatcccatgttttccaacagatgagcttggctgacttctcggggtgggttggggggacatgccacatgcctctggccccaccatctcatgcctttgccatccatctcctgactggccagaaggacaccaggagcagctcatgagctacaaaaactgaaggtcgggaacccaaggtcgtgcaccaaaggtcatgagaattttgcattttatgttgctctcatttctgatcatttgaaacaacctctctgagtttctgaaagggaagggaatggagaaaagcacacccaattatgctaggttctgttttattttggcttttgtttttgttttttttcccacccaccacaagttcttttcttcccctctcatagtgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtgctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 352 - DNA, 384633 bp, Homo sapiens; identical to SEQ ID NO: 351
  source 1..384633: mol_type = genomic DNA

SEQ ID NO: 353 - DNA, 25680 bp, Homo sapiens
  source 1..25680: mol_type = genomic DNA
aaagagcccgctccgccgagcgccgggcgacggcaggtacgtcagtccgcgagggtcgccgcagcgccccttgcgccccttgcgccccttgcgccccctcagctttccggtgcaccctccctgactgggagcaccgagtcgacccgcgggccgcccgggtcctgacagggaagagtccccgggagctctgcggtgccccgggagcccacaggtgtttctacgctcccgcgtccatttggcctgggtcttccaaggggagccccgcgacccggctggtgcggccggacctgctggcagctgggaccgggagggatgcgggcctcagaggatcctcaccctgaggcaggtggggccctggatgccggcgctgctctgattttactttgaggccgcttctcctctctcagtttacccggccagggctcagtattatgcacaaatctcaatgatgtgctcttgggtaatttacaaaacgattttactcccaagtaacttctttcggtctgttatttagaaggcagcaagtcagagtcctccgtgagcctttttttcctctttaaagttctaaaatgtgcagtccctgacccacctgtcttcaaaaggttcatatgaagagttcttagtactttattctatctctggctccccaaccctatcccagtcttggacagcgtggggctgaggacactaaaaaatatttcaacttgatctcagcagatgaggctgtattgaaagtgggtagaggctgggcgccaaggctcatgcctgtaatcccagctacttgggaggctgaggcgagggaatcgcttgaactcaggagatggaggttgcagtgagccaagatcacgccactgcactccaccctgggcgacagagcgagactacgtctcaaaaacaaaacaaaacaaaccaacaacaacaacaacaaaagaaccttagggccttagggcacactttctcaggacctcttgagattgtgtaactccagcaaactattaattaaaaaaaaaaaaaaggccgggcgaggtggctcacgcctgtaatcccagcactgtgggaggcggaagcaggtagatcacctatggtcaggagtttgagaccagcgtggccaacatggcaaaaccccctctctactaataatacaaaaattagctgggcgtggtggtgcacgtctgtaatcccagctacttgggaggctgaggcaggagaatcactttaacctgggaggcggagattgcagtgagccgagatcgcgccattgcactccagcctgacgacagagggagactgtctcaaaaaaaaaaaaagccaggcatggtggcttacacctgtaatcccaacacttaggaaggccaaggcgggaggattacttgagtccgggagttgtaggtcagcctgggcaacaaagggaggccccatctcaacaaaaaataaaaaactagcaggactcatgcatagtcccagctacttgggaggctgggatgggaggatcgctggagcccgggagtttgaggctgcagtgagctgtgatcacatcactgcgttccgccctctggtgacagagccggaccctgtttctcaaaaacaaaacaaaacaaaacaaaagcctagcctgcctgtgctattaaagcaatggcaaaagccaaaattacttttgcaccaacctaatagctatgtttctgctttttaaactacagttttcttgtctagagcttcagtgagataagaaccaattcttaggactgttgggtgggtcatatgaagtgacactgatgtgcctttgccatagtgcctgaaaaagcactccatatgtattagctacttgtatcattttaccttttttgttaatctctcaggggatgtccctcagccttgcttgattcccgaggccttccctgatttttttcttcttcaggacagtctttaactcagagaatgtttgagagcttccagtccttcctccttcagggacaggttaaactctcctgcttccttgcctggctggaaggattatcattcattgagccactggtgtgtgccacatactttacattgtatttcatgctgaaaacagtcctgggaggttgatgtctttggccttaaatttcagattaggaaactgaggcttagagaggttaagtaactgctgggcatggtggctcacgcctgtaatcccagcactttgggaggccgaggcaggcggatcccaaggtcaggagtttgagaccagcctggccagcatggtgaaaccccgtctctactaaaaatacaaaaaattatccaggcatggtggtgcgcgcctgtagtcccagttactcgggaggctgaggcaggagaatggcttgaacctgggaggcggaggttgcagtgagccaagattgcgccactgcactccagcctgggtgacagagcgagactccatcttaaaaaaaaaaatagattaagtaacttgctcaggatcctacaggaagcaggaagaggtagagatggggacagagccttttgggactgatacgcaacccaggactgttcctctgcccctgtcattagtaagggatactctccccactctggccatgacctgtcacctgcccatgtctctctatcactatgctgagatgaagactgggctcagaacttctgggccattggactctctggggcatttcttttttttcttgagacagagtcgctctgttgcccaggctagagtgcagtggcgtgatcttggctcactgcagcctccgtctcctgggttcaagtgattctcctgcctcagcctcctgagtagctgggactacaagcgcgcatcactacacccggctaatttttgtacttttaaaagagatggggttttggcatgttggccaggctggccttgaactcctgaactcaagtgatctgcccactttggcctcccgaagtgctgggattccggatgtgagctaccacatctggccatttcaagggtttctttctttctttctttctttcttttttcctcagacagggtctggctttgttacccagggtggaatgtattggtgccagtttactgcaacctctgcccccagggctgaaacaatgcttccgcctcagcctcctgagtagctgtgactataggcacattcactgtgcctggctaatttttgtatgtgtgtggttttttgtttttttttttttggtagagatggggtttgccatgttgctcaggctggtctcaaactcctgggctcaagccatccgcctgtcttggcctcccaaagtgctggaattacaggtgtgaaccactgcacctggcctcttgctgtctttcagtgcctttgcttgggaccagatatcattatcactatcacctgaataaggatccaaaagacccaggtgtgttgcaactttgactatagcgtctcctggcctctgtgaagtggagataataggagataataatacttatcttgcagggtctaagggtgttgtcaagataaaaaaaaaaaatcacagcaccttaactgtggtccagagtgctcagtcctagtggctattattaattttttttctttctttctttcttttttttttttttgagacaaagtctcactctgtcacccaggctggagtgcagtggaacaatctctgctcactgcaaccaccgcttcccaggttcaagcgattctcctgcctcagcctcctgagtagctgggattacaggcacccgccaccatgcctggctaatttttgaatttttggtagagatggggtttcaccatgctggccaggctggtctcaaactcctgacctcaggtgatccacccgcctcggcctcccaaagtgctgagattataggcgtgagccaccatgcccggcctattaattttaattttattttttttgagacggaatctcactctgtcgcccaggctggagtgcagtggcgtgatcttggctcactgcaacctccacctcccaggttcagcctcccgagtaactgggattacaggtgcctgccaccatgcctggctaatttttgtatttttagtagagacagggtttaccatgttggcgaggctggtctcgaactcctgacctcaggtaatcttcctgccttggccttccaaagtgctgggattacaggcataagccaccatgcctggcatcctagtggctattattactaaaatcatccctcccttgtatttgtttaggctttgtcataattataatagataatacatactgagtgctttacatatatttcctccttttgtacttcagctctacaaagtaggtttattgtagtggttaagcaagtggaccctgtagtggggagcatgaatttaaaaattaattaattaaatttaaaaataaattaataaaaaaaaaggctgaggcaggaggattgcttgagtccaggagtttgagaccagcttgggcaatgtggcaagacccaatctcttaaaaagaaaacaaacagtgaaaaccttagctaggcatggtggcatgtgcctatggtcccagctatacaggaggctgaggtagcaggattgcttgggcctgggaggtcgaggctgcagtgagttatgattgcaccactacactccagtctgggtgacagattgagaccctgtctttaaaaaaaaaaaaaaaagtaaaaaagacaataaaaaaagaggccgggcatggtggctcattcccagcattttgggaagccgaggcaggtggatcacctgaggtcaaaagtttgagaccagcctggccaacatggtgaaaccctgtctttactaaaaatacaaaaattagtcaggcgtggtggcacatgcctgtaatcctagctactcgggaggctgaggcagggagaattgcttgaacccaggaggtggagattacagtgagctgagattgtaccactgcactccagcctgggggatacagtaagactccatctcagaaagaaaaaaaggtaataaaatagatactctggaaaaaaagtttagtttcaaacttcactctgccacttgctagctttggcaagttacttcatctctctgtgcctcatttctccgtctttttttttttttttttttgtagagtccaggtctctgtatgttgcccaggctggtttctaactcttgggctcaagcgatcctcctgacatggcctcccaaaatgctggaattatagacatgagccaccacacccagcagtttcttcatcttttttttttttcgagatagatttttgctcttcttgcccaggctggagtgcaatggtatggtctcggctcactgcaatctctgtctcccaggttgaagtgattctcctgtctcagcctcccaagtagctggaattacaggtgcccaccaccacatctggctaatttttgtatttttagtagagatggggtttcaccatgttggccaggctggtctcaaactcctgacctcaggcagtcctgcccctgtctcccaaagtgctcggattataggcgtgagccgccaaccacgtctagcctcttttttttttttttttttttgagacggtgtctcgctctgtcgcccaggctggagtggagtgcagtggcgtgatctctgctcactgcaagctccgcctcccgggttcatgccattctcttgcctcagcctcccgagtagctgggactacaggcacccgccaccacgcccagctaattttttgtatttttagtagagacggggtttcactgcattagccaggatggtctcgatctcctgaccttgtgatccaccctcctcggcctcccaaagtgctgggattacaggcgtgagccaccgtgcctggacttctttttttttgagacagaatctcgctctgtcgcccaggctggagtgcagtggtgtgatcttggctcactgcaacctttgcctcctgggttcaagtgattattctgactcagcctcctgagtagctgggactacaggcacgtgccaccacatctggctaatttttgtatttttattagagacggggtttcaccatattggccaggctggtctcaaactcctgacctcgtgatctgcccgccttggcctcccaaagtgctgggattacagatgtgagccactgcgcccaggtggcagtgcagttctaagctgcctgccagaggagtctggaatttcacaggaataggtctgtttcagtgtcccagctgtgctcagtcactggttgtgagaaggttcgttcaaagcgtggcctccatgtaaacaaggtgggagattcagatcgtagcagctgggggcgtctgttagttacactccctgctgcagctgacctgagggttagacgtgcctacggccatacagtaaattggtggcaaagttggagggagggcttggtgggcatcctgggaggagccttcaccctcaagtgcctggctgggatctctagctggaatttcccctctggatttccctgctgggctgagtagggaatggagcaatttctgacagaggcttttcctgaaggcgtgggtgttgctgagtggtggtgtcctgtcagcctcttctcttctggtggcagcagagcctggcactggaatagcctgtggctgagcttcaggtttcctgtcactttggctggggtgtgggctgaccaccagatgtgtgctcagggcgcagctcagccagtggtgagcagcttacttgcatgggcttttcccatgctgagttttgaggggtggagggaggaaatgggggtgctgctttgtgggacagcagtgggagccctgccagaggtgaatgtgtgggtactcctgggggactcggtctcggggaggccaggggctcaggagtcagattggttttccatctggcaggagtgctggcaggttgggggagacaggggtgggggtgaagccaaatctttggccttgctttccccctacttgctgagagtgccctggaggaagatggcgggcaggtagggctgcagcccccgctgggctggctgagacccctgggaagggaggtctccaagtgcctgctcctgcagctctgagtgcatatgcgctccccacagctgcccccttctccggggaacccccatcagcttgaggagcctggggggtggggttaggcatttgctctcgccttcctttcccccttgctttgggtggccccaactcttaccccatcctgctgccctcccttcctccttcctgggcacactccctggggaaatcacacccatccacattttggaatgtcagcagacatgctgaccacgtgacccagccatccgccttggtgtccacctggggagatgaaatcttctgttcacacgaacctatctccggaggttcatagcaggactattcacatctgccaaaaactggagatggcccagatgctcttcagtgggtaaatggagaaacagatgcggcccatccatgcgagggatcactgctcctccgaaaaaaggcttgggccacagatatgtacaatgacttggatacatctcagaggcatcatgttggatgaaagaagctaatctcaaaagattatattccattttatttgacttttttttgttttgttttgttttgagggtcttgctgtgtcagccaggctggagtgcagtggagtgatcatggctcactgcagccttaacctcctgggctcaagcagtcctcccaccttggtcttccaaagtgctgggattatagacgtgagccactacacctgtcctggcctttattttattttagttaattaattagagatagggtcttattctgtgacccaggctggagtgcagtgatacagtcatagcccactacagccataatctcccaggctcaagcagtcctcccaccttagcttcctgagtagctggaactacaggcacacgccaccacgcctgcctaatttttgtatttttagtagtgaagaggttttgccatgttggccaggctggtctcgaactcctgacctcaggtgatctgtccacctcggcctcccaaagtgctggaattacagatgtaagctactatacctggcctgttcgacattttttcttttatttatttattttttttgagacggagtctccctttgtcgcccaggttggagtgcagtggcgcgatcttggcccactgcagcctccgcctcctgggttcaagcgattctcctgcttcagcctcccgagtagctgggattacaggcatgccccgccacacccggctaatttttgtatttttagtagagacggggtttcaccatgttggccaggctggtctccaactcctgacctcaggtgatccccccacctcagcctcccaaagtgctaggattgcaggcatgagcctctgcacccggccgacattttctaagttgatgaaactatagctttagagagcaaatcagtggttgtcagggcgtaggcggggaggagaggttgcatgaggaagtttttttgagtgtagatggtgataccaacacgaatctatacacatgttaaaatcatagaattgtatataaaattaattacttttagttatgatggtttaaaaaatagtcacatctacccatattgctgtctcaggaagcccctccgcttggccagaatggagcagccgaagggagttgattggacagtcatcatcctgacctgccagtacaaggacagtgtccaggtctttcagagaggtaggggactccccttcccaccttgcccctaatggagaacctccctccccttcctggctatgtccctccaacaccaggtgccaggccaacctgggttcaaacccagattgcacttctccctagccatgtgacagcatacgtggcatgtcattccttgtgccttagttttctcatctgtaagatgggagtaatatgacttctctcactaagttgggtgaagatctagtggcctcctacatggaaagctaagtcaaggaagatcaaacactgatgatcagtaggcttgcttacgtgctttgggccagggcagagagctggggggcaggtcccagtgtctcttctgaccctagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtgagtgctcaccagggccacctccctggtctgtgtccctgctggaaccaggtcatttctgagatccccagctcctctggctccatcgccttggccaactcagcattggtctcagtttttgtttctgtaaattgggcggactcatctctgccttgccgttcaagtgagggcagaaggcagggccagcttttgcagtgtttttagagagttgtagccaatatctcaaagtgaggctttctggcttctcttgaaacattcaaaggtcttgctagcctgggctgtcatccccatatggcaacgaactgttcgctggacctgagctgcggctgcctgctttgggcaggccatgtgagtcagcatccctgctggtcccgtgtctcccatgcaaccagccacttcacccggtcaccttgtctgcatagcatctttgtgtgcagagtgagggcgagcacagacttggacatgctctgcagagggagatggcaccagcaggggaggggaccactgtagctgccatggcgctgactcccctaagtcacccagccagcccccaactcttgttgcctgtaacctccccttcaaaacagacagcagaggccgggcgcggtggctcatgcctttaatcccagcactttgggaggccgaggtgggtggatcacctgaggtcaggagttggagaccagcctgaccaacgtgatgaaaccccgtctctactaaaaatacaaaaattagctgggcctggttgcacacacctgtaatcccagctactcgggaggctgaggcaggagagtcgcttgaacccaggaggtggaggttgcagtgagctgagatcatgccattgcagtgagctgagatcatgccattgcagtgagctgagatcatgccattgcactccattctgggcaacagagcgagactgcatctcaaaaaaaaaaaaaaaaaaaaatttaagaggtagccaggcgtggcagtgcacacctgtagtcccagctagttaagaggctgaggtgggaggctcgcttgagcccaagagaccaaggctgcagtgagctgggatcataccactgcactccagactgggtgacagagtgagaccctgtctcaaaacaacaacaacaacagcaacaaaccagccagcaagaaggtggcccaggtggagggccctgggatcccttatccaggagggaccagggctgccccttgtctgcctgtggccattggtttgaccttgccttttgtcccttgggtacctgagtggatttgtgttggagtctctctctggattcgagggtgccatcctccagggcgtctgcctgaggcctctgttcacagggctttcccactcctgcaggtggtcacatccgatgtcctgcactcggcctggatcctcattctgcacatggtaaatgaactttggggcaggggccaagcagaaggccagaatcccagttcgtggagttgagcaggacttcaggggtgttctgccactgtgtgtgtgcaagatgaaatctgaaagattctaaatgtccaaaaattgggaaatggctaaatatataccacatattttcccagcagaatattagattgaaaggtccatctagggccgggcgcagtggctcatgcctgtaaatctcagcactttgggaggccaaggcgggaggattgcttgagcccaggagatcgagaccagcctgggcaacatggtgaaacctcatctctataagaaatacaaaaattagccgccatggtggtgcacacctgtagtcccagctactcaggaggctgaggtgggaggatcacttgagcctgggaggttgaggctgcagtgagttatgattacaccactgcactccagcctgtgtgaccctttctcaaaaaataaaattataggctgggcgcagtggctcacatctgtaaagtggctcacacagcgctttgggaggttgaggcgggcagatcacaaggtcaggagtttgagatcagcctggccagcatggtgaaactctgtctttactaaaaatacaaaaaattagccaggcatggtggtgcatgcctgtagtcccagctacttgggaggctgaggcatgagaattgcttgaacccaggaggcggaggttgcagtgagccaagatcgcactactgcactacagcctgggcaacagagcaagacttagtctaaaaaattgcagtgcaatgcaatgcaatgcaatgcataatataaaaatatattgtaggagaaaatatcaagagaacattttttatcagccctccactggatggctttctgcctgcacagctgatgaggtggccttgggctctgtgcactgaggcttcctcaccagtcccccgacttccagggtcgagacttcccctttgatgactgtggcagggctttcacctgcctccccgtggagaaccccgaggcccccgtggaagccttggtctgcaacctggactgcctgctggacatcatgacctatcgggtgaggctgggtggtggcccgtggtgcctcgtcccagatagagccacttccctcccactgttcccccaggtatgatctatgctggctcagctgggagaaggaatggttttgagggtgcctaatgttagttaagagcttcaagaagttagttgtgtctgggggcagtggctcatgcctataatttcagcactttgagaagccaaagtgggaggatcgcttgaggccaagagttcatgaccagcctgggcaacacagcaagaccccatctctacaaaaaaatttttaaaaaattacctgggcatgatggcatgcacttgtagtcccagctactcaagaggctgaggcaggaagatcgcttgagcccaggagtttgaggctgcagtgagctacgatcgcactactgcactccagcctgggtgacagtgagaccctgtcgcaataacaacaaataagttagtcttggtcacatggggaaagttgtaaacccaggtcagagagtgggtgggggcagaccaggtcttggaggcccttgttacttcaacagcacagtatccttgggcaaggagggggcaggtgaaggcctgggccaggcaccagctgtgttctgtctccttccccccacagctgggcccgggctccccgccaggcgtgtgggtctgcagcaccgacatgctgctgtctgttcctgcaaatcctggtgagcctgagactacctgggactgccttccttcgtcacagccacagcaagaagccagctctgcccttcttgcccaccctgcctctgggcctgccccgctgccctattagacgggaagctggagggtgtggagaatgaagcctggtggaggcagggcttctcctgctgtgcctcagtctgtctgtctataggatggacagaagcagccctgccccttctgtcccacagggctctgcggaagaactttgggagaggagggttgtcattctcccaggcgaatgtccatttggcttggaaaccgtatttcccttttagaggtgcccaggtgccgcagccctgggctcttgcttccacctggtggggaaatccgtgccttgggtggaggcccctgggagcctcctgactgccccaccccacaggtatcagctgggacagcttccggggagccagagtgatcgccctcccagggagcccggcctacgctcagaatcatggcgtctacctaactgacccccaggtagtgcccctggggacagtggagccggctggggcagccttcctcctgtcagtgggcagcctcctccctgtcagtgggcagcctctcatcctggatttcctcgcatgttcctgaatccaaggagtttcctccgtggcagtggcaccagtgctcccttactctcgccaaaaatacatttcacaccgaccgcctgtccagtctctgtgcccaggctcagggctgcaaagacctttaaagcctgccctctgccatcatggagtagaaatctcaggccccccctgagaatgccagcaactgccagccttgcgtcctcagctttcctttggagaatgcccttgctgccacctgtggctgtggcctccttccagatcccttcctgctccctccgctgattctgtttctccctgcacatagggccttgttttggacatttactaccagggcactgaggcagagattcagcggtgtgtcaggcctgatgggcgggtgccactggtatggctgctgggcccaggttgcggggctttggggaccttatgggacagggagggagggtctgacttccttcgattccttctagaagcctccaggacaagctagagctagaatctgaggacagggtagccttggaattcagggtcttgtcctgagccagaaagcctagaaccaggcgggcacggtggctaacgcctgtaatcccagcactttaggaggctgaggcgggtggatcagttgaggtcaggagttcgagaccagtctgggcaacgtggtgaaaccctgtctctactaaatacaacaattagctgagcatggtggtgtgtgcctgtaatcccaactacttgagaggtagaggctcgagaatcgcttgaacccaggaggcggaggttgcggtgagcagagatcgtgccactgcacttcagccagggtgacagagcgagactctgaatcaatcccctgcccgctgtaaaacaaaacaaagcaaacctcaaaaactcaaacgaaaaaagaaagcctagaaccagaatgtgagcaagttagggagtgcggttgggaggaggcctagagccagactccgggaatgcttccatcatgaggggcaaggattggagaggcatggagatctgggagtggaccatggcgagggtggagaactgggttcaggagaaggcctgacagttgagggtgtcccagaaggtgtcttggtgggagctaccccaagtaagcctggagtctggctgctggagtggtcagaaggtgacactccctgcctggtatggcactcagcttcatgtggcccatctgcatgtgccctccctgacttgtaccagggcctggtccagggccctccatctctgatccttttggggtcccttccaggtctctggggttgtcttcttctctgtggagactgccgagcgcctcctagccacccacgtgagcccgcccctggatgcctgcacctacctaggcttggactccggagcccggcctgtccaggtgactgggggagggcagctaggtggggcctggcttgggggcgaggcactgtgtgacctcaggccagccacttcccctctctggggcagagtctccgcagacgggactgccctggttcagcctcagaacttgggggctgaacccctgccatgccaatagctgtgcttcttccccttcccctagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatgggtgggtactgcctctcagctccctggggtggggagaccatgggagtgaggaccccaagaatggagctgctcactgcatgctgggccaggcagcccagcacagggactgggcagttctcctgtcctgtgccagagccccccactgagctacctccttccccttcttgtcttccttttgtctcattcctgggctctcccagcctgtccacttttgtttctgtttttttttgtttgtttgttttgttttttgagacggactctctctttgtcgccccggctagagtgaggtggtgcgatctcagctcactgcaacctccgcctcctgggttcaagcaattctcctgcctcagcctcctgcgtacctgggataatagccatgcatcatcacacttggctaatttttctatttttagttggtcaggctggtcttgaactcctggcctcaggtgacccgcctgccttggcctcccgaagtgctgggcttacaggcatgagccaccatgcccggccctaacctgtctgctttctttttttttttttgagacagagtatggctctgttgcccaggctggagtgcagtggcgtaatttcggctcactgcaacctctgcgtctcaggttcaagcgattctcctgcctcagctgcctgagtagctgggattacaggtgcgtggcaccatgcctggctaatttttgtatttttagtaaagatgggatttcaccatgttggtcaggctggtctcgaactcctgacctcgtgatctgcctgcctcggcctcccaaagtgctgggattacaggcgtgagccactgtgcccggccaacctgtctactttctagctgtgttgtgtggctttgggcaggttcctgactcagcttcccctaacaggctcatggccacacctgcccccatgtgtctctgctgctgggaggcagcctggcccctgagtcgcagcaggcatggggttgggttcagtacttatgtctttacagcctatgtctccagcggcagctacagctacatgacctcctcagccagtgagttcctgctcagcctcacactccccggggctcctggggcccagattgtgcactcccaggtggaggtgagacctccctgcccctccggtgcctgctggttgtctggggtcaggtgggatgtggattcccgggaagaaaatagccggcacttggaacagatgacccgagtgcaggtgttaccctggtttacacatgaagtgctggaggctcagagaggctaagtaacttgcctaaggccacagagccagtaagtggccaactcaggattctgcattgagcttgcctgattgagaagctaaaggagacctttatttggggtctgcctggggtgacagtggtgggcctgggtcagtgccgtgctgctgaggaaggggacaggtagggttcagaggtggcccccagggtggcaaggttgggcgtagttggacaggtgggatggaaataggtctcaggctggggccaaggcaggtccagagaggagtctagggtgctgcagggcaggggagcagtaggcctggacgctttgcccctggatgcttggcttgggaggagagctggggcagccctgggcctcgacccccctcatgctcctcctacctggctgcacaggagcagcagcttctggcggccgggagctctgtggtcagctgcctgctggagggccctgtccagctgggtcctgggagcgtcctgcagcactgccacctgcaggtgaggcctgagcgtgtgggcagattggggcgagggtgctggcatcccgcatgtgttggggggtgttgggtgcctgcccacccaggatgcctgccctgtcccccaccagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggaggtaggcagtcaccctgcattccctcacccccatcttcaggctttggggagcccaaggagtcctggcccccaccccactgcggggttctctgagcactggcccgtgggacaggctgtgaggagggtcggatgtagggaggagagaatgagggaggagatagggtgaagataggctgtgagaccagcagagtctccacaggcctttacctccctccttgcatctgctctgccaggtgggctgggtggggattttgttttttttctggagatagagtcttgctctatcaccaaggctggagtgcagtggcccaatctcagctcactgcaatctctgcctcccaggttcaagcgattctcctgcctcagcctcacgaatagctgggactaccagcgtgcaccaccacgcccagcttagtagagatggggtttcgccatgctagtctggttgggtggggttgttgtttttttttttttttttgagactcactctgtctcccaggccggagtgcagtggcgcaatcttggctcactgcaagctctgcctcccgggttcacgccattttcctgcctcagcctcctgagtagctgggagtacaggcgcccaccaccacgcctggcaaatttttttgtattttttagtagagatgaggtttcaccgcgttagccaggatggtctcaatctcccgacctcaactgatctgcctgcctcggcctcccaaagtgctgggattataggtgtgagccaccgcgcacggctgggtgggggtttttatccttatttgacaggctagagactgggattcagagagggaggtaacccgccttgggctgcagcctgttgtggtgggctgggcctggaacccagggttctgctccagatttcaggcaccttggcgggagtgttggggctgcagggctgaaaacaatttcagaaattgctccatggctgggtgtagtggctcatgcctgtaatctcaacactctgggaggccgaggtgggaggccaggagttcatacctgcagtgagctgaccacaccactgcactccagcctgggtgggtcaagtatgttctttgtctgtcttcctgccctcatgtgagcacttgagcagctcctggccccctggccgagtgtctctaaccctttcctgtggcccctgcagccctgactgcttcttcctctcccccagagacagggggcaggcacatatctcaacgtgccctggagtgaattcttcaagaggacaggtgttcggtaaggtggacacccctagggcctctgtgggcctgggcagctggggtggctgctgctctttgaggtgtgtccctcccctgccccagagcagcacgggccgtgttaccatccaggggcctgggtggttttgggcagccggattctctccagtactttcccccgggcagctcccagtctctggctgtgctgactttggctttcttgttcaatggtctgggaaaggatgccaggcagcctggcccccgacctgaattgcccacttatgctacctcggaggagtctgtcctgtccccatgaactgacaggcggctcagggcttggggaagagactggagcttttgcttccctcctgggaatgtgccttctccccacatcagagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccagggtgagtgtgcaggctggtagtgctgcagaatcaggccaggggcacctgccctccctgtcctctgggccatcccctgaggggactaggggaccatgaggtgctcaagcagggaaggggcatgctggagtttacttttaggattctggaaggcctcatccttgtcaatggggtttggtctgaggttgaggcatgttcatccttgtcagtggggtttggtcagaggttgaggcctggcagctgagctctaggtcctaggcacatcggcaaaccctgcgtgttctgtactgggtgccaggatgtgggtgcagagcgtggcgaggggacagagcccccaggggacatggtcatctctgcatgaggtcccaagcacacttccgggggctcacagccttagcctcctaggctgaacctcatggaaggtcccagggaccgtggacatgaatggtattgaagccactcacccagagccacacggctagctggtggtgaggctgagacctgagcccaggtggtttgagcccagagcctgagctcttcaccactatgggtgtcctgggtgggggtgaagagacacctatgggctgggactggcaagacgagatgatctctgccaggcagagagcaggagtgcagttacagtcaaagatacattgtgggcaaaagccaggaggtgtgaggggtctggcgcatttagggactgttgagtagcctctcgtgaaagaggattttgaagacaggcctcctcccctgccacccccaactccttgtccctcagttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggtgtgtactaatggaggtcagatcccttggataagccccttgctgtctgggaagtggaccctgatggaggaaacccagagagaggtggggctcccttgggtaccccgggacagtcaggtccccaaagccaggcaatctgcccccagcttggggctgcatgccaccatccctcccccttctcttggcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctggtgagccccttgtggcaggtggggttgagggtagctgccccagagccaggctggcagcttctgtgaccagcttgagtcttgccacactgccatagggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggtcaggcaccctgggacctctgcaggtggggctggccagctgggggctcggggcagaagctagagactgcaggccagtggggtctggcctgagggccagccagtctggctgaggagcctgaagggaaggaaggggctgggagtcaacctgcaaagatgacacgtgtccctgtctgggagcccagaggcccttttgtggcttggggatggggccagtactgctgctgggcttttgtcccaccggatgagtcccgcactgggctgggaagtccagggtgggtgggtgcctgcgtctgcccatcgagactgaattcctttctcatgcctgtccttctgcaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggtgagcgggccctgcctcctgctacccaccgactgttacagccctccagccttgcctgtgatcccccttcctggcctctgcccttagacggagtcaggcaggcctgggcagggtggaggtgtttcatgtctgctctctcctctccgccctgcaggcaccagcagcatcctggcaggcactgccctggctgccttgcagcgagccgcaggccgggtggtgggcacggaagccctgatccacgcagtgctgcacctggagcaggtgctcaccactggtatgtgactgccctggagttggaggaggtcactgacactttcccaagggcccgcggggggagtggggctcccctggatttgcatgtgattggccaacagccacaagactgtgctgctgttggaaatactttccttctagtcactttgaccttctctggtcgttttcaacctgaaatgttctacctcccaacgagccgtttcacaagcatctactgagtgccagattctgtgctgtgccctttttttttttttgagacggagtcttgctctgtcgcccaggctggagtgcagtggtgcgatctcagctcgctgcaagctctgcctcccgggttcacgccattctcctgcctcagcctcccgagtagctgggactacaggcgcctgccaccacgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggcctgtgctgtgcctctcatgcttgttggaaccaggtgctgtgcttcgtgactgtgcctttccagggctgtgctggggtagggctgggcagagctgctttggaccttccgcctgtcctggcatcgtgcccttacttgagatatgatcacctgtgcccccgcccccaccccctggccatatggtgggacagcaagagcccaacaatgactatgatctaatgaatgtcaccagcgccaggcttctcactcctcctggccaccgagccccctggaacccatggccagtgtagagcagctacagcttgtctggtttcaggtccacctcagggtgtcaggtcccgtctccagcacacccctggaaagaaactgctgcaaaggcctactgaagcctgactgtggtgttttctgtcactctgcagctcaagcctcacatttcactgtagtgactcatatcccataatcggtagtcattagcaaaaggagcagatggggaagcattttcagttttcttttgaggtgtaccattcaagttctacatttggccaacggaaaactatttgttgagaacccactctgtggggccccagggataaaatgagcaaaaatggggtccctgccctcaaaagtcctgtggtctcctggagacagacattaatcaataactactcaggtgcatgtgtattacaaactgtgccaagtgctttgaagcagaggggcacagttaagtcttgacatttcaagacttagccactttgcaactaccaggttttggctgcaaagttccagatggcttctgtcttttgcatttcatactttaaacccttgcaggcccttccctaactatcaagggcctgtcccagaagcaactcaagttttgttatttttaatttttttttatttttgagatggagtctagctctgtcacccagattggagtgcagtggtgcgatctcagcccactgcaacctctacctcccgggttcaagagattctcctgcctcagcctcccaggtagctgggattacaggtgcctgccaccatgcccagctaattttttgtatttttagtagagatggggtttcactgtgttggccaggctcgtcttgaactcctgacctcatgatccgcctgccttggcctcccaaagtgctgggattacaagcgtgagccaccatgcccggactagttttgttatttttatgcagctacaaggaggaaaatgatacatacctttcattactgaagatggaaagatgtgtaagttagataagagaaaaacagatcctgatgaccttccttccaacataaaccacctgtcagaagacggtgcagggagactcaggccaaagggaaggtatctgtcagcctctcctctgactaaaactcccctaggaggggcagaggtcagtgtaaaatatgtattttttgagacagagtctcacattgtcacccaggctggagtgcagtggtgcgatctcagctcactgcaacctttgcctcagcctccctagaagctgggattacagggcatgcaccaccatgcctggctaatttttgtatttttggtagagactagatttcaccatgttggccaggttggtctcaaactcctgacctcaaatgatctgcccgccttagcctcccaaagtgctgtgattacaggcgtgtgccaccgtgcccggccatagtgtaaaatctttattcttcagtgtggtttatcccaattccaattatacattaggtctaaaacaaaactcaggccttgggaattccaagctttgccctagagtgaagcccattcccttgctgggattgttctggggacagaagctgcatagctcactgtcctgtggagttgagggaagctatctttccacactggtcccagcaaggggtgcagggccgggagcctaggctgggagagtgaagctgggccagatagactccaacagtgacagtccctgggctcacaggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggtgagctctggccccagcatgagggaggcaggcagggggcctgccagctgggcctgggtcctcaccaccccttctcctgccccgtccgcaggatgtgctgaggagctggtatgcccgacttcctgctgtggtgcagaatgcccacagcctggtacggcaaactgaggagtgtgctgaaggcttccgccaaggtgaggggcttcctctgggggggtcagggcactgggagcgagtattctgtcacttgtgggtttgaggccagggtcatctgcaggcttggcacaagctccagatattcggcctctgggaacagaagcctactgtctgtcctctccagggtctcacatttaggggagagctacatctgaggacaaaattttcatcatgggaaaggccctccagccctaacaggaagcagagaggggaagggactcaacccatggctgagttccaaggaagtctgagctgggcagggtccccagtgtgtggcttcacagctccctagatgccgactatgctgggtgtggtgttggttgcttcctgcacattggtcctcaggcagtcctgggaagtgggttactcctggctccagccggcactggaatccggcttctttaccatgacactggctcagcagcacgtcttggcacttcatgcaatctccagatgggtgctgagtatcttggcccaggcacgtcactcccctctgccccacctcaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgaggtactgatggggctggggttggtaaagagacctctgggggcaagagacctcactgtggcccaccagttaaccaggggctatatctgtaagtccccctggtcctgcaggcccagtccagcctccagaaggcctgagatttgtccagagccttctaaatacttcctgtcttgtccagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgca

SEQ ID NO: 354 - DNA, 42986 bp, Homo sapiens
  source 1..42986: mol_type = genomic DNA
tctctccaaggagtagctttattcagggatcataaacatcacagcctctcctcaaagtcaagcctaactgctaggtccccagatgtacccaagttgtctaggactggcaggggtagcttgtttgctgtagtgtttgagggcaagagactgaccatccatgcagaaagctggcctgggctgctcgctgcctgccgtggctttcccacctcattaggagcccgcttctctcggtggggagatgctgcccccagagcatcacctggccaggtctgagggcagagcatggagtgggtccagactttgtttctctgctgccagccgtagaaaggtctgggctgtcagatctcccccaagccagacagcctcgctcagctccttggctggggccccttagggaacaggcctgcaagtgtgatgagccaggtgtgctcatccaggcagctacaggcgcagcctcttgatatcttcactgcggaagtctatccgcagggccagcacctggcgcacttcagcaggggtgaggcgccacgtcaatgggccggaattgggtccccagtaatcgaggatctcggtcacctgtggggaaggacatagagaccagtcagcaaggtggggttattctgaaagagggctctggcctctaccaggggcagagcaggggcacccgggaaggggaaggtgtcctatagagctggctgctggcagacatggtttagagggaagtggcggggatccatctttgcctctttcagtcacccctccctggctgggccaagggtgccccacctacccgctccagattgaggatggtggccatctgggagagccgggcaaacttgtctcggatggtccaggtggtcaccgtggtaaggtaggcaatgagcgacctcagctccttgtcaaactgcagaccacccagctgcaggagaacccaagcccagtcactacttaggcctggccaagcagaactggcctccagttgcccccagagctgggtggcaaggcccgccaggcctcaggtggtgccctgtggtttgtttgctctacggcttcagaagccagagcaggactggacccagacatgcagggcctgtgggcagcagacagaggggatgcaagtcctgggggtggtggcatgacatgtcttcctcagaggagaaacgagagccgcagacccatgacccctttaccttacccggttaaaggtggatttcagcaccactttctccaactcgacggcaacaaggctagtcatgaggccggttaggctgtcgtagatgaccggggacaggctggcctgcacacagagggttgacatcagccgagccccacctaactcctctgcctctatgctggagtcttaggtggtgaggatagtagcgtgaggccacgggggagtttctacaggtgagggttggaagggctttcagggtccccagaaggaatgtgatgagaccctgcaggctgctggtttgggctgacgtgggtaattccctaagtggatccctagggcccctgctcaccttgaactctgccatttgctgctccaggttaaggatgaactgttgtacccaagggtcgttggcctcatagtcattgaattcttcctgttgtcaggaagcagggctggtcaccatgggcctcataagaagtaccattcattgccacccacctctatccctctaagaaaataatgtaaaacattcttccttccctgtgccttctgactcatctagtttaaaaccagctcagacacccaggctggcagaaactgaccagcaaacagcccagggctgtagcagtggcccacataacatggtaaagttcctggcattttattccttcttggatctcttgttctacaggaatgaaatcactacgccaggaggaaaaaaacgcttctaagtctatcataggcggggcaaaaagagctccaataagggaataagttaggtcaaggcaaactccatgtctttctgagcccttctgactagggacaaactgtttcctgggaggaacctagtcttcatgggtcagggtgggggaagtgggcctgggaagcatggaaggtctagtctgttcagatggctctgctccctctagctggggctagggatgaggggtcatcggggcttgatggctgcctgtggccaggctaacctcctcgatgttgtgggagacggagaaaaagctgttgatccaaggctgcacctgtggcttgatggctgtgctgttgagctccgtcagcccttcctgcacaaggacaaggtggagacatgtgacacagaaggcacgactcatcccttccctctctcttctccccatcccttccctctatcctctccccatccctttcctctcctctccccatcccttccttctctcctctccccatttcttccttctctcctctccccaccccttccctctcctctccctaccccttccctctcctctccccaccccttccctctcctctccccactccttccctctcttctccccaccccatccctcttttctccctaccccatccctctctcctctccccaccacatccctctctcgtctccccaccccttccctctctcctctccccaccccttccctctctcctctccccaccccatccctctcatctccccaccccttccctctctcctctccccaccgcatccccttctcctctccccatcccttccttctctcctctccccaccccatcctcctctcctctccccatcccttccctctctcctctccccatcccttgactgcagggcgttcttccagccctgaggctttctgcaggccctgttggaggttataacagagctagtgctaatgaaaggaggagccaggaacatgcccctttccagatctcagctgattcaggtccagggtaacgatgaggccttgagactgttctgataaactctcacaagagatttcagaatgctcaatgttaggcagcacctgcggctaggtcagaacaaccatgtggctccacttcctctgagcatcttctgagagctcttgtcattgtggggccaagtgcaaagtctagagcaccagatgttggcttgtcagtgtgacaacttcactgctgagaaaccaacagggcctttagtctcaagggacctgcacaactccaggctccagggcttgcgtgctgctccctcacccgtcctcctggcttccttgcacacgatgagccagctaacaatcttctcagagcaacacacaggcacaggattcagtcagcagttgaacctggggcttacctgcaagaggtctcggaatttgttggacacggcggccaagtcagaaaggcagctgtcaaacttggcctgggcctgctcccctccaatgccctggctgaagagcttggtgcagtcactctaggggagaacactgctgtaagaccaccgagcacgcgtgggccatgggagtgtgaggagccaccagccagttctactcctccagccagctatggcctgtcaagagcccggatgggtttcagaaaacctggattctatcctggtggttatccacttggctcccacttccccctctgtaatatgggggtaccaatgtcggggaagtgagtaagaaacagaaataccagaaagtttttcctgtctttagagtcagacattcctaggttcaagtcctggctcagtcatgtattagttgagtgaccttgggcaaatgatttaaagtttctgagcttcaattttcctgtctataaaatgggaacaccaattcctgctcctcatgtatgagatgaagcacaacgtgcctagctcaatgcctggcacaggagacactagctattattgctatagttcctcctttcccccccttttatatttatttacttcttcttaaattttatttaaatttaccaaaaaaccacaaaagtcagtttctgcttcttaaatattttggtatggctaccaaaggggatggtcaagatcatagctaaggtttaagggcgtactgtatacctggctttgttctaagcatttcacttttattaaagtaccaggctgggcgaggtggctcatgcgggtaattctagcactttgggaggccaaggtgcaaggaccacttgcggccagagtttaagaacagcagggaaacatagtgagaagccgtctccacagaaaattaaagaattagctggatgtagtggtgcgcccctgcatccctagctactcaggaggctgaggcgagaggatcccttgagcccaagggttcaaggttgcagagagctatgactgccactgcactccagcccgggcagcagagtgagaacaaagtacctattctacttaaaaacaaaacaaaatgaaaaccaaaaaacccccacaactattgtaagttactttgaccttcataaaaaaaagtatctcctttatgaaataggtaaaattattatccccattgtacagatgagaaaactgaggcacagaagttaataatttattcaaagccatggcaataagtcaggaaaggctgagcatggtggctcactattgtaatcctaggactttgtgaggccaaggtaggaggattgctggagcccaggagttcaagaccagcctgggcaacaaagtgagaccctgtctctcttttttttttttttttttgagacagtctcactctgtcgccctggctggagtgcagtggcatgatctcggctcactgcaacctccgcctcctgggttcaagcgattctcgtgcctcagcctcccgagtagctgggactacaggcgcctgccaccacacccaactaatttttctatttttagtagagacagggtttcaccatgttggccaggctggtctcgaactcctgacctcaggtgatccacccgcctcagcctcccaaagtgctggatttacaggtgtgagccatcgcgcctggcagagaccctgtcttttaacatagataaatcatggagctgggactctaggccaggtattctgactccaaaaatcctgttttttttgttttttttttttttttgagacagagtcttgctgtgtcacccaggctggagtgcaacgacatgatcttggctgactgcaacctctgtctcccgggttcaagtgactctcccacctcagcctccggagtagctgggattacgggcacccaccatcatgcccagctaattattgtatttttgtagagatggggtttcaccatgttggccaggctggtcttgaactcctgactgcaggtgatctgcccgcctgagcctcccaaagtgctgagattacaggcgtgaaccaccgtgtacggcccagaatgcctgtctttttttttttcttttgagacggagtcttgctctataacccaggctggagtgcagtggcttgatctcggttcactgcaagctccgcctcctgggttcacgccattctcctgcctcagtctcccaagtagctgggactacaggcgcccaccaccacgctctgctaattttttgtatttttagtagagatggggtttcaccgtgttagccaggatggtctcgatctcctgaccttgtgatccgcccgccttggcctcccaaagtgctaggattacaggcgtgagccaccgcgcccagcccagaatgcctgtttctaatcaccacactacagcgtaggtgtagagacctctccagggggaactgcctgaaactcatgttttgggttgccaggagctgccgcattgctcgtagccttcttagaaagttcatgctgttttggctccagaggggaagcagagtggaagaactaagagggactctcctagcagacaaaggcccttcactcccacagtattcctgacacttactgtctttgagtagtcttgtaaccttccctgtaagctgaacgtcatgccacctgatctgcctatctcaaagggctgctgatggggctaagaaagaacatctgtgaaatgcaaatctaagggcagctgggatttacgggaataggtttttcagctattttacttggctaattctaccagctcacttatgaatttctaatatttccccaaattttacttccaaaacccaacagactcatgttaaggatgaggtcagaaatagtctaaagtgccatgacttacaaacaatgatgtcggccgggcgccgtggctcacgcctgtaatcccagcactttgggaggccgaggcgggcagatcacgaggtgaagagatcaagaccatcctggccaaaatggtgaaaccctgtctctactaaaaaatacaaaaattagctaggtgtggtggcgcacacctgtagtctcagctacttgggagctgaggcaggagaatcgcttgaatccgggaggtggaggttgcagtaagccgagactgcgccactgcactccagcctgggcaacaagagcgaaacttcatctcaaaaaaaaaaaaaagtcaggcatggtggctcacacctgtaatcccagcactatgggaggctgaggtgggcggatcgcctgaggtcgggaatttgagaccagcctagacagcatggtgaaacctcgtttctactaaaaatacaaaaatcagctgggcatggtgtcaggtgcctgtaatcccagcaacttaggaagctgaggcaggagaatcgcagaggttgcagtgagccaagatcatgccactgcactacagcctgggcaacagagtgagaatcggtctcaaaaaataaaaaaataaaaataaaaaaaaaaaaagacaaggccaggcgaggtggttcatgcctgtaatcccagcacttcgggatgccaaggcgggtggatcacttgaggccaggagttcgagaccagcctggccaacatggcaaaaccccatccctactaaaaatacaaaaattagctgggcgtggtggcaggtgcttataatcccagctactccagagcctgaggcaggagaatcacagaagttgcagtgagctgagatcgcgccattgcactctagcctgggcgacagagcgagactccgtctcaaaaaaaaaccaacaatgatgacagccaacttgttgaacacatacgatgtgacagatactatgttatgttgtacaagtgttcactgtggaggcagggccctggcctcacttctttcccagaggctgagtttgggagtggggaagaactgggcccccctcattttccaatagttcacaaagtgatccctccatgctgttatttttattttgttaattttaaatttatttttactatttttacttttttttttatgtttttttgagacggagtcttactctgttgcctaggctggagtgcaggtgcacgatctcggcttgctgcaacctctgcctcccaggttcaagcgattctcctgtctcagcttcctgagtagccaggattacaggtgtgcaccaccacaaccggctaatttttgtatttttagtagagatggggtttcactatgtttgccaggctggtctcaaactcctgacctcaggtaatcctcccgccttggcatcccaaagtgctggggttataggtgtgagccaccacacctggctattatttttaccttttttttttcttttgagatggagtctttctctgttgcccaggctagagtgaagtggcgtgatctcgactcactgcaacctccgcctcctgggttcaagcaattctcctgcctcagcctcctgagtagctggtattacaggcgcccgccaccatgcccagctaatttttgtatttttagtagagacaggacttcaccatcttggccaggcttgaatgcctgatcttgtgatccacctgccttggcctcccaaagtgctgggattataggcgtgagccactgcgcccagcctattattgctttttaagtgatggggtctcattatgttgcccaggctggcctcgaactcctggcctcaagcaatcctcctgactcagggtcccaagtagctgagactacaggcacgagccacccagctattgttattttgagatggagtttcgctcttgttgcccaggctggagtgcagtgacgcaatctcggctcactgcaacctccacctccggggttcaaacaattctcctgcctcagcctcccgagtagctgggattatgggcacatgccaccacacccagctaattttttttgtatttttagtagagacagggtttcatcatgttggccagaccggtctcgaattcctgacctcaggtgatccacctgcctcggcctcccaaagtgctgggattataggcatgagccaccacacccggcccagctactgttatttttaactgttaatacaactaataagtaccactgcatgcctctcatgtactaagtggttcatattaccacattcctctcataacagtcatgtggcacagaggtcattatccctgctttatgaatgacaagactgaggttacagaacttttgcctaaggtcacacagctgggcagtggtcaagtgaagatttgaacttggggtatctggcttcaaagcccaagcaatttccactatactctgcttccttcctctaaaaataacagctactagctttgtataggattaggcaaaccttatcttaatctcctacatttatacagggatttgtcatttttataaggtgcttttgatcctgattttttttttttttttgagacagaatctccctctgtcgcccaggctggagtgcagtggcgtgatctcggctcactgcaacctctgcctcccaggttcaagcagttctctgcctcagcctcccgagtagctgggattacaggcgcctgccaccatggctggctcattttttgtatttttagtagagatggggtttcaccatcttggccaggctggtcttgaagtcctgacctcatgatccacccgcctcagcctcccaaagtgttaggattacaggcatgagccacctcacctggccttgatcctgatttaaaaaaaaaaaaagttttttttttttttgtagagatgaggtctcaccacattgcccaggctggtctcaaactcctggcctcaagtaatcctcctgccttggcctcccaaaatgttaagcttacaggtatgagccacttggcctcaatcctgttttttcattaggctacccaagaaacacaagctagggctggatggagctatgcatctcatttcgtagatgagaggactgaggctcagagggctaagggacttgtccaaggtcacacgccaactatgtgctggaagatctaatttgtgtgttattttgagatagagtctgctctgtcgcccaggctggagtgcagtggcacgatctcagctcactgcaacctctgcctcccgggttcaagtgattctcctgcctcagtttcccaagcagctgggattacaggtgtctgccaccatgcccagctaatttttgtatttttagtagagatggggtttcgccatgttggctaggctggtctcgaactcctgacctcaagtgatccacccgccttggcctccgaaagtgctgggattacaggaatgtgccaccgtgccttgcctggaagatctaatttgaattctgatcttccaactcctgagcttttctccctggtccaaggatgccttgctatcatgtcagtcaccaaagaatcccctcaagtgtggctcaatgtcaccaagataagtgtcttcaccatgatgtttgtatagggctctatctcaacatgggaaaagatggctgctgaccactgataggcaatttccctcgtacctccagtgtcttcttcagagtggagatgttttcactgcagacttccacgttgttcagagtcacctgggagatgaggaaggaagaacgtgacttcctgctgactgtgcctgccacccactccaatgccagactggctgacagctgtgctccatgaagctcagagaagggctggctggagttcagacttgcgctaatgaaaacccacactgctacatctgagcaggacgctcagatcttggattgggcagaatggggaagcaggctcgccctttcttctgtgcctgatgacagggagcctaaagctatcaggacctcagaggtagtgagctcaggtttcaggtcttctttttttgtttgtttttttgtttttttgagatggagtctggctctgtcacccaggctggactgcaagctctgcctcccgggttcatgccattctcctgcctcagccacccgagtagctgggacaacaggcgcccgccactacgccaggctaattttttgtatttttagtagagacggggtttcaccatgttagccaggatggtcttgatctcctgacctcatgatctgcccacctcggcctcccaaagtgctgggattacaggcgtgagccactgcgcccggcgaggtttcaggtcttcttgtactgtgttacctacagagcagaaatgactcaggcatacaggtccaggataagttctgaggctccaaacggtcaagccccaggtcagtgatacaaagcctgacattcattaaagaaaagcttccagagagcctgccacctatgaggtattttctcattctttatctcatggagtctgctaaatacccccatagaacacgtattatcaagcccagtgcacgggaggaaatgagactcctcagaaggtaaaatgatttggccaggcacggtggctcacgcctgtaatcccagcactttggaaggccaaggcgggtggatcacctgaggtcaggagttcaagaacagcctggccaacatggtgaaaccctgtctctaataaaaatacacacaaaaaaattagccaggcgtggtggtgcacatctgtagacccagctaccaggaggctgaggcaggagaatcgcttgaacctgggagatgagaggttgcagtgagctgaaattgtgtcactgcactccagcctgtatgacagagcaagactctgtctcaaaaaaaaaaaaaaaaaaaaaagctggggcagggtagctcatgcctgtaatcccagcactttgggaggccgaagcaggtggatcaagaggtcaggagtttgagaccagcctgcccaacatggcgaaaccccgtctctactaaaaatacaaaaaattagccaggcgtggtggcgggtgcctgtaatcccagctactcgggaggctgaggcaggagaattgcttgaacttgggaggcgtaggttgcagtgagctgagatcacgccactgcactctagcctcggtgacaagaacaaaactacgtctcaaaaaaaaaaaaaaaaaaaaaaagtaaaatgattcacgaaggtctgacagcaactgattcagcaaatatttactgagcacctggatgtgccaggcacagttctaggcactgagagaaagcaattaacaaaaaagacatggtccactcctcacagagctgacattccagaagggaagccagatagtaaacaaatgcattatataatgccaggaagaataataaagcaggaaaagggacagacactcagagtgacaaggccacaaagctggagccaggcttagaattcgggtctctgagcttccagatggataaacaggtggaggttcctggacagtggccacctggggagggcatggaagctccataccccttcccccataatttgccctattcatctcttcatctgtatcctatataatatcctttataataaacaaataaactaaaaaaatgaattcaggtctccctactctggtccaaagatgacttttttcataacacgactgtcttacagactaggtgcagaaataccaatgataaaagtagcatggaggccaggcgcagtggctcatgcctgtaatcacagcagtttgggaggccgatgcgggcagatcacctgaggttgggagttcgggactagcctgaccaacatggagaaaccccgtctctactaaaaaaaatacaaaattagccgggcgtggtggtgcatgcctgtaatcccagctacttgggaggctgagacagaagaatcacttgaacccagcgggcagaggttgcagtgagccaagatcgcgccattgcactccagcctgtgcaacaacagcaaaactccgtctcaaaaaaaaaaaaaaaggtagcatgggcacggtggctcacacctgtaatcccagcactttgggaggctgagacgggtggatcacctgaggtcaggagttcgagaccatcctggccaacatggcaaaaccccgtctctactaaaaatacaaaaattagtcgggtgtggtggcaggtgcctgtaatcccagctacttggggggctgaggcaggagaatcgcttgaacctatgaggcggaggttgcagtgagccaagatcgcgccattgcaccccagctggggcaacaagaacgaaactccatctccaaaaaaaaaagtagcatggggcaaaattattaaggcactaattgctctggccattcagaggaaagaacaaactgtttcggtgtaaggcattcaaggaaggttccatgacagggttggtagctgagctgaacataaaagggtagaacataattctgacaggagatgaaggtgagaacatttctccacccccagcagcctctctccagctcactgtcctatttgatattttcttaatggtccttaggatttcctgacattctctggtttatctatttcttgtctgcatggatctagcctgttttcttcaccactgcgtctctatacagcactgtctacctttctgcttgatggaaatattctaactgcactgtctggtatggtagccctcagccatgtgtggctattgagcacctgaagcatagctagtacaactcaggaagtggatttttaatttaaatgtaaatttcaatagccacctgtggctggtgactaccatgttgggcagtgtagctctagaacccagaacagtgcctgatatttagaagtttctcaataaatatttgtgcaatgagtaagagagtgaatgaacatattctggaaaggggataatataagcaagtgcagaatggcacaaaacccaaaaaggtatttgagaaatagcagagtcagttcacagacacgtgcagggaagtggcaggaggtagagctgcgaggggcagagactgacggggacttgggtgctctgctgcagagttagccctgtgacctgtggacagtgggctggcactgaggatttttaaagcaggtgaatgccacatgagcacagctgtggttcaggaatactcatctagaggccgtgggagggaggaaatagagggcctggggatcccactgcctgtaaactggtctgctggtggcatgatgaggaaggcaggggtgaggtaaggaggagccagtcttcgagacatgagtcaggagcttcaggatttcagggtaaaaggaggatctcagaaccccaggggctgtgattaggaagtccctctcatcttgcccagagtgcttcccttgtcggtgtcctgcagccagtgctgaaagtcatgatgctgacagtgctgcttaggccactctgattgtggacagataagcctaaaggtctttctttaatatgccacaacatgaggcctctaatgtcacaagtttccaaataactgtcctgtcctgacagctgaaggatgaaggccataagtgtttccaaggcatttaagagcaccaagaataactgtcatgaggacttctggatttgagttcaaatggtattgatttcaaagtttcccctgtactgacagccctagtaagcgtggattcactgggtttattccctgcccacagtgcatgatgtcagtaaatttggagaattcatctagacagccaaatgaatcaaggtgacataaaaaataggccctgcaatgggagtgatgacattttaaatacttggtgtcaggaaaaccagaaacctgtcaccaagcatttagcatcgcctctctttttggtcttatcttctggggcctcaaacaatgaaactgtgttaatgggaggtcctcacagagcgaatatgcactggccggttttggagacatgtagtcaagtggtggaaaacggaactggaaaggtggtatgggttagagttaggaggcttaaacaaagacatctagctttgatgtggtaggcagcaagcagccaatgattatttctgagcacagaaatgaaagtaagttctgtaaaaaaaatcacaaacaaaataaaaatttaagttggttcatgatgtgatgctggttgctgggcattttggcaaagttctccaaaggtaacaactttcacaggcaacagttttttggatctgatctttttttggcagcaaccatgatatcctagattgacagaaaccatacacagggcaaatattttctatgacaggaagagagtggggctgcctaaacagctttcacattggatctgtctcataactagttactatgggttcctctgcacagggcttggtagatattagcaagtttaggcttctctctctgcaagtaacagctctgaactcttttgggggtcacagatccttttaagaatatgataaccaggcacggtagctcatgcctgtaatcccaacactttgggaggccaagacgggtggatcacttgaggtcagaagttcgagaccagcctggccaacatggcaaaacccagtctttactaaaaaaaaaaaaaaaaaaattagccaggtatggtggcgcatgcctgtaatcccagctactcgggaggctaaagcaggagaatcgcttgaacctgtgaggcggaggttgcagtgagccaaggtcatgccattgcactccagcctggggaacaagagcaagactccatctcaaaaaaaaaaaaaaaagaatctgataaaagctaaggaaggaccctgtgacccaaaaatgcatgtgaacatttttgcgtccaaccccacttgtgggctacagatgctactagatgtttctttcaggctctgagcctcaggagtcaagactcagggtgcggccaatgtgggggatggagcagaatggacctcggactgtgctactcccatgcgtgctaagacagcgtgtgccagagaggcctgatcttgagcttaggattcatctgtggtctttctggctcatcacaaactggttgttgctttgtacaaatcctttcatccttctgtgctcctcctttccaagctgtcacacaatggaaggcttgctgctttatcacatctgtcattctgggtagcaaagggctttaataaagcctcctttccagaggaagttgaaagcctaagacatgtactagcagagcagtgatggcaggcccgaaggactggcgcctgcccatgctgcgggcctctcctcagagaagcagtctggtggtctggcacagatggtagagctggttctgtggcagatgcaagccaagcttggcactcagtgggctcctgagcagctggccagtgctctggggaatgaattctaggtgacagctggacagcccagcctctatcgtggctcaggtgactcagaatatgtccctgagtaagaaatagtttcagaaccttctgggaggaaattcccttaaaggaggaattttccttctatatagacactggaggaaaagtctctagctagaggccaattatactgtggcttagcagtgatagcgtaacctctcgagataaaccaacccagctcgtgagctgtggggtacctaccaggaaggacatcttcgcctcgtcagtactctcgatgccttttgtgtcaaatttgccttgctggaggctgctgtgcatgatgttcacggcacttgtcaccccgcgctggatgtcctggaaggtggtggcaggaaagcccatccgcagcttattacacagaacatccctggggggcaggattgcatagaggaattgacagtgctcaacttggccaccaggacagaagggccagtcttcaccactctgacccagcagcacaaggtgctcttttagggggaataaccagtccttaagaccactgtaggagacctgaggagccagggtatgaaagtaaccagcaccccgtcaaggacactgatgtgacaagaacatacaggggagactggccaatctctactgttcatgaggcttttagccatcaccactgcactcccaacaaagctgtgcggcttagtgaacgcagtaccatgtaggagttgagaacaggttttgagtcactcagttctggattccaccactgactcctaagtggtggatctttgacgaggacggaatctccctaaagcacagtttcttcatctataaaacagagctaacagttcctacttcatagggttgttattaggacctcaaaagcgcaggagattagcatagtgctgggcctgtagcaatggtacctattggtggtattattcatctgaactgcctgttctctttcctacgtctaagggcccatagctccttcagtctagtccagggaacagaaatttggcccatgagatatatggctgaccaacagcttcctggagccaaggatactatcttagggataggagctgatgtcctgtatagaacttaactagaatcatgaggacaaagggcagaaacaaatgggcctcaggaatcaacaggaagggcctttctgcctagaaaggagaaagggagtcaactgtacctgaagtcagactccagctctgtggtggcgaggttgatcatggcacagagacagtcaatgctggagctggacagagcccgcccaatgcacttcttaacaatgtagaagacatcatccaccatgctggatgtcagctggcccttctcataggtgtccagagccacagcctacccaaaaggcaaagccaacactgagggtcccagttgtgcatgtcatgttctagatgattctgggtacactggccctagctctgctcccttttctgtaccttgtccatgtttctcccaacatggcgtgcatcctccttgtcaaaatagcttacttccctattgatcactaggtgaacaaattaaatatttcgggccttagccctgcagagatccattacctggggagtgtaagatatctgcaggggccctacttccctgaggctccttacccacaaaccttcagggaggtagggaacaagtgggctccctgaagagctgagctgagctgttcttttttaattcttgggaaggaagtcctagctgggtatacaaagaacacaacgactccaaagatgctctctaaacatacaaagtggtaccactcaatctgcatgcaagagtattctcaaagcaggaccaataaatatgacatgcctcagccatttccctcagcctggcttcttggaccggaagccccatttccaagagatgcgtcctatgtcctaccttattgacagtctccctcatgaagtactcctccatggtaacatataagccaattagctcctgcatggtacagctcaaaaggcagttattgaggagtttgtccagacacttctggtgctctaggggacagccaagaaaggaatactcattttttttccccaagggaaacagagcaacttttttcattttttcaggttcctttatagtctttctttgaaatatgtacatattttacatcgttacaatcatgatacagatagcaattttgaattctgttttaaaaaagtatatcataaatattttccatgttttcacctaccttatttttcatgactatgtggcatttcatcaggtgcataatccacattttaaaaactactttttttatttttaactattttttttttttgagacggagtttcactcttgttgcccaggctggagtgcaatggcgtgatcttggctcaccgcaacccctgcctcccaggttcaaacaattctcctgcctcagcctcccgagtagctgggattacaggcatgcaccaccacgcccggcaaattttgtatttttagtagagacagggtttctccatgttgaggttggtcttgaactcctgaccttaggtgatccgcctgcctcagcctcccaaattgctgggattacaggcgtgagccaccatgcccggccttatttttaactttcatgttgtttcatgtgaaattgagaaaataaccactctatttttagacacctggttatttccaaatgttttgccattactggagataacagaatatcacaataattggagattatagtgaatacttttgtatgaaaaactttttactccttttccattattcccttaggattaattaataggagtcaaaagatgtaagtttccatggcaaagataaaaatatattggatatagaatatttcattctctacaccagtactgtccagtagaatttctgtgataatgaaaatattctggtcaggtgtggtggctcacacctgtaatcccagcactttgggaggccaaggcgcgaggatcgcttgggtccaggagttttgagaccagcctgggcaacacagcaatactctgtctctacaaaaaataaacaaacaacaagaaaagagaaaatattccgtatctgttatctgatatagtagccattagccatgttagcgattgagcacttgaaatgtgatgaacataacttaggaactgaatatttttttttttattaaatttttttttctcagaatccagctgagaaagatgaatttaaaattttatttaattgtaattaaatttgaatttgaatttgaattcatgaatggctacgtattgggcagcacagctctgaatagtgatagtcatcattattgcttttcagtcttttggctaagatcaagtgatagtcatcactgacattgacaagcgaactccaaatgagcacacaatttcctttatacactgattctgtaatgcccctgccacatattattggcacaagccatgcagaatgccacagatgctgggtgggtctcaagtcccagcccaaagaaccctgcatatatttgcccagcaggatttttatttttttaaatttttttcctttaattcttactttagtagccagcaggaattaaatggtcatcttaaaaacctagcgagtcaatctgtaaatgaaattggactctggcatgccttttaaacaatttatttatttttgagacagagtctcgcttgtcgcccaggctggagtgcagtggcgcgatcttggctcactgcaagctccgcctcccgggttcacgccattctcctgcctcagcctccagagtagctgggactgcagacacccgccaccacgcccggctaatttttttgtatttttagtagagacggagtttcaccacgttagccaggacggtcttgatctcctgaccttgtgatccgcctgcctcggcctcccaaagtgctgggattacaggcgtgagccaccgcgcccgacctaaaaatttttttaaatgtttatcttttattatttaatttaatttaatttaattttttagagatggggtttcactatgttgaccaggctggtctcaaactcctgggctcaagcatccttcctcctcggcctcccaaagttttgggattatgcgtgagccaccatacccagtcaaaatttttatcttttaatatagtgacagggtcttgtcatgttgcccagactggtcttgaactcttgagctcaagcgattctcctgcctcagcctcccaaagtgttgggattacaggtgtgagccactgcacccagccccctttcttatcaatgtcaattattccttgaaaaattgtgactgggggaactgggagactgagagggatgagaggattcctgtacattatatactctttttttttttttttttttttgagacagagtctggctctgtcacccaggctggagtgcagtggcgtgatcttggccctatgccccccagggttcaagcaattctcccgtctcaacctcccgagtagctgggactgcaggtgtattgcaccacgctcagctaatttttgtatttttaatagagatggggtttcaccatattggtcaggctggtctcgaactcctgacctccggtaatccacccgcctcagtctcccaaagtgctgggattacagatgtgagccaccgtacctggcctatgtactctttaaaaacaaaaaaagaacacttcattgaagtataatttatatcccataaaatttaaaacagggcaccagtgtcctcatctgtaaagtgattagatggcctcaaagatctagtccaattctaaaatccagtaaatttagatttcttcctgggagtcaatttgcctacagaccaccaggggctaataagttccaattgtttccttaataagagatttgtggcttaactattaagaaacactgccaattatacctcaaccctccccaaaaatatgggaaacgtttttaccttgctttacttcctctgaggccatggagtctcccacctcaaaatcagagctaatcctcttcttgaggaagcgtaagtatagctcactgcgggcattcatcagggtgacctcagtcaggatggggtccagttctctgagacacatggagcagaaggaataggacgacaatggattaccttagacacaagagctacagggcaaagagagtcccaaattccccctccccactgggcccataaggaaaagctctgccagatggccctcctagctctgctggcccaattagaatcagagatagctgtcaatcacattttccatttacctgcttcacctaaatcattcactccctaaaattctgccagacctaaataaaaggttgggagatgtgtcttcttttctttacttttttttttgagatggagtcttgctctgttgcccaggctggagtgcagtggctcgatctcagctccctgcaagctccgcctcctgggttcacgccatttctcctgcctcagcctcctgagtagctgggactacaggtgcccaccaccatgcccggctaattttttgtatttttagtagagacggggtttcactgtattagcgaggatggtctcgatctcctgacctcgtgatccgcccgcctcaacctcccaaagtgctggaattacaggtgtgagccactgcgcccggcctattttcttttctttttgagacagagtcttgctctgttgcccaggctggagtgcagtggtgcaatcttggctcactgcaacctccgcctctaggttgaagtgagtctcatgccttggccacatgagtagctgggattacaggagtgtgccaccccacctggcagattttttttttttttttcagatttttgtatctttagtagaattgggattttgccatgttggctaggccagtctcgaactcctggcctcaagtgatcctcctgccttggcctcttgaagtgctgggattacaggcatgagctacagtgcctggcctcttttgtggtttgaataaagattacctatgaccaggcatggtggctcacgcctgtaatcccaacactttgggaggctgaggcgggcggatcatgaggtcaagagattgagaccatcccggccaacatggtgaaaccccatttctactaaaaatacaaaaattagctgggtgtggtggcgcatgcctgtagtcccagctactcgggaggccaaggcaggagaatcgcttgaacccgggaggcggaggttgcagtgagccaagatcgcgccactgcactccagcctggagacacagcaagactccgtctcaaaaaaaaaaaaaaaaaaaaaaaaaaaaaagaggccgggcgcagtggctcacgcctgtaatcccagcactttgggaggctgaggtgggcggatcacctgaggtcgggagttcgagaccagcctaacctaaccaaaacatggagaaaccccgtctccactaaaaatacaaaattagccaggcatggtggcacatgcctgtgatcccagctactagggaggctgaggcgggagagtcgcttgaacccgagaggcggaggttgcagtgagctgagatcacgccattgcactccagcctgggcaacaagagtgaaactccgtcttaaaaaaaaaaaaaaattatcagtgtctcatgtgaaagaaaactctccaatctctaatttagccctggcaggatgttaggaaataccattaaactgccctacacccattcatttatcctgatgaatagccaaaataatcttgaaaaatacaaagttggaggaatcccactttctaatttcaaaactaactacaaagccacagcaatcaagactatgtggtactggcatatgaatagatatatggattaatggaacagaactgtgagtccagatggttgactgattttcaatgagcgctaggacaattcaataaacaacgaagggtcttttcatcaaattgtgctaggacaactgagatccacatgaaaaagaatcaagttgaacccctacctcacataatataaaaaaattaacttcctttgcacactgaagtccaagaggtcttttctttctttctttttttgttttgagatagggtcactgtctgtctcccaggctggagtacagtggcacaatcacagctcactgcaggctcagcttccctgggatcaggcaatcctcccacctcagcctcccaagtagctgggattatagacatgtgccaccatgtctggctaatttttgtatttttggtaaagacggggtttccccatgttgtccaggctggtctcaaactcctgggctcaagtgatctgcccacctctgcgtcccaaagtgctggggctacaggtgtgagccaccttggcacctgaccccaagacatctttacaaacataaatctggtcatatcatatagtttccatacctctcagaatacaagactcttaacagcctgactctaatgatctctccatatccaccatttcaggctctcctctactctttgaacttcagctacactggccttctttcagtttttaaaatacacatgacctttgcacatgctttccttgctctatctggaatactcctcacatcttaactcctacttactctttttttttttttttttgagacggagtctcactctgtcgcccaggctggagtgcagtggcgctatcccggctcactgcaagctccgcctcttgggttcatgccattctcctgcctcagcctcccgagtagctgggactacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaactcctacttactcttaaggtctcagatctaaggtcatttcctcaggaattatttcttcaactttcccatactaggctacatctctttatgacatgctgtcctgcaccctacactcagtatatcacagtggctgacagcatccactctagagtcagactgcttggattccatttctcaccgccattttctagctgcatgaccttgggcaagtcatctgacctctccagccttcagtttcttcctctggaaagtgtttatggattaaatcagtgattttctactgagggcgattttattcccagctcccccattcccctacccatacccccctggggtattttagcatctagtggatagaggccagggatgctgctaaccatcttacaatgcgtagaacagtccccacctaacaaaaaattatccagtcaaggctgggtgcagtcgttcacgactgtaatcccactactttgggaggctgaggcgggcagatcacctgaggttaggagttcaagacctgcctagacaacacggtgaaaccccctctccactaaaaatataaaaattagccagacatagtggtgagtgcctgtaagctcagctactcaggaggcagaggcacgagaactgcttgatcctgggaggcggagattgcagtgagccaaaattgagccactgcactccagcctgggtgacggagtgagtgagattctatttaaaaaaaaaaaaaaaaaaagaggccgggcatggtggctcactcctgtaatcccagcacttgggaggccaaggcgggtggatcacaaggtcaggagtttgagaccagcctggccaagatggtgaaaccccatctctactaaaaatacaaaaatttgccaggcacactggtggggcgcctgtaatcccagctacttgggaggttgaggcaggagaattgcttgaacccgggaggcgtaggttgcagtgagctgagatcatgccactgtactctagcttgggtgacagagcaagactgtctcaaaaaaaaaaaaaaaaaatccagtcaaaatgccgttagtgcagaagttaagaaaccttggattaaatgatttaatatttgttaagtgttcagaatagtgtctggcatacagttgacattacatatgtattagctattgctattatctactttatagaccatagatgccacgaagaaaaaattatgtttgcttgctcactttgcttgttgccatatcaaggactagtatctggcacatgtgtactcagtaaaactttggttgaatgaatatattttacgtttggattttcttttttttttttttttttgagacagagtctcgctctgtcacccaggctggagtgcagtggcacgatattggctcactgcaacctccacctcccgggttcacgccattctcctgcctcagcctcccaagtagctgggactacaggcacccgccaacacacccagctaattttttgtattttttttttagtagagacagggtttcaccgtgttagccaggatggtcttgatttcctgacctcgtgatccacccgccttgggctcccaaagtgctaggattacaggcgtgagccaccgcacccactggattttcttctaagaagcacatgttatttttattgtaaaaaagtaggctgggtgcggtggctcacacctgtaatcccagcactttgggaggctgaaggcgggcagatcatgaggtcaggagatcgagaccatcctggctaacacggtgaaaccccgtctctactaaaaatacaaaaaattagccgggcgtggtggcagacgcctgtagtcccagctactcaggaggctgaggcaggagaatggcgtgaacccgggaggtggagcttgcagtgagccgagatagcgccactgcacttcagcctgggcgaaagagtgagactctgtctcaaaaaaagaaaataaatgaaataaataaaagtttggctggatacaggggctcatgcctgtaattccagtgctttgggaggctgaggcagggggaatcacttgagatctggggttcaagaccatcctgggcaacatagcaagccctcatctctaccaaaaattaaaaaattggccgggtatggtggctcatgcctgtaattccagcactttgggaggccgaggtgggtggatcacctgaggtcaggagtttgagaccagcctggccaaaatggcaaaacctcatctcagccgggtgcggtggctcatgcctgtaatcccagcattttgggaggctgaggtgggtggatcatgagggtcaggagatcgagtccgtcctggctaacacagtaaaaccctgtctctactaaaaatacaaaaaaaaaaaattagctgggcatggtggtgggcgactgtagtcccagctacacgggaggctgaggcaggagaatggcgtgaatccaggaggcggagcttgcagggagccgagatcgtgccactgcactccagcctgggtgacagagcgagactccgtctaaattaaaaaaaacctcatctttactaaaaatacaaaaaaattaaccgagcgtggtggcacctgcctacagtcccagctacttgggaggctgaggcaggagaatcgctaaacctagcaggtggaggttttggtgagtcgatatcacaccatgccactgcactccagcctgggcaacagagcgagactgcctcaaaaaaaaaaaaaaaaaaaaaaaacaaaaaaaaaaacatttagctgggagtggtgactgtaatcctagctagtcaggagctactcgggaggctgaggctggaggatcgcctgagtccacgagttggtggttacagtgtgctgtgattgtgtcactgtaccacttcactccagcctgggaaacagagaccctgtttctaatttaaaaaaaaaaagtaaaagtttaaaattttaggatagtagttacctttgtgggaagggaagaggagagtcactctgggggcttcaaaagtgtagtcatgctacataagaatattttggtcagaaatgaactgctgggctgggcatggtggctcatgcctgtaatcccatcactttgggaagactttgggaggtgagaggatcacttgagcccaggagttcgagaccagcctaggcaacatggcaaaacctcgtctctacaaaaaatacaaaaattagcccagcatggtggtgtacaatatgtgtacaccagctactgatatgtgtcccagctactcgggaggccgaggtgggaggattgcttgagcccagaaggtcaaggctgcagtgagccaggatcataccaccgtactgcagtctggcctgggcaacaaaataagaccctatctcaaaaaagcaaaaaaaccccaaaacaacaacaaaaaaaaactgtatcggtatacacaagagggttcccataatattataccttttctatgtttctatggtacagtacataatactgtacctcttctatgtttagatatgtttagatatacaagtacttaccatcgtgttataattgtctatggtattcagtatagtaatatgccatgcaggtttataccctaggagtaatagtttgtatcatatagcctaggtgtgtagtaggctaagtacaccctacgatgttgacacaatggaaatcgtctaatgatgtatttctcagaatgtactccagttgttggcagggtatggtggctcatgcctataatctcagcattttgggaggctgaggtgggcggatcacttaaggtcaggagttcgagactaacctggccatcatggcaaaaccctgtctctactaaaattataaaaaattagctgggaatggtggtgcacgcctgtagttccagctacttgggaggctgagggaggagaatcgcttgaacctgggaggcaggggctgtagtgagccaagataatgctactgcactccagcgtgggtgacagagtgagactctgtctcaaaaaaaaaaaaaagtattccagtcattaaatgacacgtgattgtactgattataatttattatttatttattttttgagacagagtctcgctctgtaacccaggctggagtgcagtggtgcaatcttggctcactgcaacctccgcctcctgggttgaagtgattctcctgcctcagcctcccgagtagctgggactacaggcacgcaccaccatgcccagctaatttttgtatttttagtagagacggggtttcaccatattggccaggctggtctcgaactcccgaccttgtgatccgcctgccttggtctcccaaagtgctgggattacaggtgtgagccaccgcgcccggctgattatgactgattacacaatttatttatatatacttttgttcatatgatacattgcactgaaaaataagagtaattgataaaatattttaaaaacatagaccacattgtaacagagtagtctgaattatattacatgattaccaattcaaactcctgtgggctgaagaagagagaaggattattaccttggttcgattttttctgttgtagaatttctcatcaggttgttctgaacatgccggaactgcaacataccacaggaatgagaatattcttccccacccccacatctattggcctcttgctggtcactccaaacttttggcatacaagaacatttagatttagtttgtttaccaggtttaccttcccttcaagccagcagtgggctttcaggatgacaggccaaagatttgtttttgggttggatgctaataatactcacctctattactgtgcttaaaagtcatgctaatggtgttccaatagactactgtttatagtctcctagtctggagttctagaaatacaattgtatgaggccactcctatttctatgtcgtacttttactttctctgctcaaaagaaggaaaaaacaaagttctgaaaaagcaaacgttatctttaacatcttaggaatgaaggggaaattggagacaattacttggacacttaataggacctcaagaaatagaattgtcattatatcattagagggcactgttgcacattttgtgatagagaactggtttactacttctgctgtgttcttttcaggaagctctttttatttccgttttggtcttgaactgaggccatcatcatctcgacaacacctcaagtccaaagtaagctgtcaatgggcaagatgcaggccagtgtgcgcttagcatttatttttctcctgtctgcaccttttttttcactttttcaaaccctacaatttattctactcagtgttcctcgctaaagctgctaccaaaccctacctgtagcttcccctgctcacctgctggtggtagtccctttgcttgatgaacttgtctaccaccttctccacctgtctgtcacattccacctgcagatatttgatcagggtatagagtctccctggcccataataggtctccactattggctggtgggtctccacaatgcgggcaatccctagaagggaggaagcaatagggttatattccaagtattcttcctacaaaataaacttgctcccatccaggactaaccgaaggtctagctcaatccttttggctgcttcactttctaaaatgaacacaaataggcctagtcaatgctaggggttgctaggcaaatatgttaaatatgtacagtgcttggtacaccagcaggcatttggtaagttacattgatactgttttctacagcagcatctttggaaatcagcatcactcgctttccagtaatttattttagggttaaatttattcgtacagagtttggggtttgagggttaggtaggatcaaaacactggagagactctaatctttgctaatcaggcactgaatctggaagttatttaattctccaatcaattaatacacaataaactacatgattaaattaaagtcatcaggctagaagggtgagaagaaaggctaggatgcaggtgtcatatacagtctccagtctctctagagcggagaaagaggctcaccttcaaacagaagagtaagtgtatctgcaaagatgactgcagctctccgatcactcatgtctgtccccagcaccatgagcagattctcctcagctttactggccacctaaaaaaggagaaaacccacacacattcctcagaaaggtcaccctcataccaggtatatctcagttttccaaaaatcctcccattgactttcttttttttcacatttcccttgatgtctggaagcccaggcagcacagaggaaactcccttgagggacagtctgagcctcaggcaggacaaggaaagtgagcatggtgtagctcctcttccattattttcttctcttggaaaatatggactgccattagccaagggagagagtccccagtttcaacaatcttctcaaagggtaactttctattattttttaaaataagacagaaactcactctgttgctcaggctggagtacaagggagccacagtcatagttcactgtggccttgaactcctggactcaagtgatcctctcacctcagcctcctgagtagctggaactataggcgagagccaccatgcccggctaattttttaaaaatttctgtagagatggggtcctgctatgttgcccagactggtctggaactcctggcctcaagcaatcctcttgcctcagcatcccaaagtgttggaattacaggcgtgagccattatgcctggcatgttatcattaacagtgctttctcaagcacgacaaaacctgggtactgcagaagggacttttactggattaaaggtagaagccatttctaggtcccagatgtcaaagtatactgataaaaaaagtaccatagagcaggtttcctttttttttttttttgaaatggaatttcgctggtcgcccaggctggagtgcagtggcacaatcttggctcactgcaacctctgcctccccggctcaagcgattctcctgtctcagcttcccgagtggttgggcttacaggcacccgccaacatgcccggctaatttttgtattttttagtagacacagggtttcaccatgttggccaggctggtcctgaacctctgatctgaggtgatccacccgcctcagcctcccaaagtgctgggattacaggcgtgagtcaccgcgcctggcctgtattttgtttttaattaactttttagaatgagtaaaatgcacacttaaacattccaaaggaacaaaggaatattcagtgaaaagtggttcttcttctaacctgtgtctcttaatttcccaattttcttcagaggtgaccattgttaacccttccaaaagaaatcctctgcttatacaaatatatcttgattgctaactccctcattttaaacaggaatgacaacatattgttttgtgccgtttaacaaaccacatgttacagaataaaatatgtcagcacttagggaacggtatcatttttcttaacggcataataatggtctgataatttttttgtgggaggggagtgacacacacagacatatagctaaaaaacggccaggtggggtggtagtcccaggactttgggaggctgaggtgggaggactgcttgaggccaggagttcgagaccagcctgggtaacacagtgagaccgtttctataaaaaaaaaaaaaaattgcaacgcatggtggcatgtgcctgcagtctcaactgcttgggaggctgaggcaggaggattgcttgagctttaagagtgattcagactgggcgtggtggctcacacctgtaatcccatcactttgggaggccgaggtgggcggatcacctgacgttgggagttcgagactagcctgaccaacatggagaaacccagtctctactaaaaatacaaaattagctgggcgtggtagcatatgcctgtaatcccagctactcgggaggctgaggcaggagaatagcttgaaccagggaggtggaggttgcagtgagctgacatcatgccattgtactccagcctgagcaacaagagtgaaactccatctcaaaaaaaaaaaaagagtgattcaacttgtcagagaacttgcattttaatttcacatgctttcgcctggtctgttggaaatgaatgtgcactggcagatgtcttggccatgcctggtacacagtaggctggcaacaggtgtgttgaatgaacacatgcatccagtcctgcatggctacacagcaagggcaggaaggggagtcatatccagaagagagaaagtatccacagaaactggatccatccagtgccccaatctgcaggcagacagccacacaattatcctgccaagcaatcagggtccatacctgcttgcaaaggtactccgagaactttcttaatccctcctcatgcaaacccagcagtgggaagatcttgaagaagcgctccacctggggcagatcaccttccttggtggcaatggcaaacttctctgccacaatggctttgagacgttgctcagcttcctgcagcaatttcaggttggcatcaatcatgctccctgctcaacagggagaaaatgaaaattcaagtaaagaatagtactgtggcaggtccatgccactttgtgtaatactattcatccagcaaatacgtattaagcacttaccatgtgcaagatgctgtgctagtaatatgcatgattacaagatgaatcagccctgatcctaccatcacagaagttaggatcaggtagaagagatagtttgtgcacaaatcaagatgatgaaatacagtacatgatgtgtcataagaaaggtgccaaagtccgggcacggtggctcatgcctgtaatcccagcactttggaaggccgagatggctgaatcacaaggtcaagggattgagaccatcctggccaacatggtgaaaccctgcctctactaaaaatagaaaaattagctgggcatggtggcatgcgcctgtagtcccagttactcaggaggctgaggcagaagaatcccttgaacctgggaggcagaggttgcagtgagccaagatcatgccactgcactccagccggcaaaagagtgagactccgtctcaaaaaaaagaaaggtgtcaaaaagtcacatttctggttaaagtaatcagaaaaggcttcctagagaaggtgacatcccacctctcaaagatgggcaggattctgatacctgcacaggagaacaaacattccaggcaaagggaatgaaagacatgaatagaagcagaaagatgaaaagaatatttgcagagtattccaagtagcatattccttggcatatggaggagcttgagaaatacttgcacaatgagtggatgcataagtgaataacattaaacaagtctagaaaaacagagtgtgtaaagatcatggaagatctaaaatatcaggctaagaatttcattttatgagtaggcaatatggccaagtgcaaagaacccgctggccagagaatcagtagatctggattcagtttccttttccataaaatgggaatacagtagtctcttcttatctgtaggggatccattccaagaccgttatggatgcctgaaaccatcgacagtactgaaccttaaatatactatgttttctcccatacatacatacctacgataaagtttaatttgtaaattagacatagtaagagattaacaataatatataataagatataacaacataccatgataaagttatgcaaatgtggcctctctcttaaaatatcttactgtactgtacttacccttcttgtgatgaagggacagacagggtggtacaagattttatcacactacttagaacagcaagcaatttaaaactagtaagatgtttatttctggaatttttccttaatatttttggactaaggttgaccatgaataactgaagctgcaggtaactgaaatggcagaaagtgaaaccacacataggggagactgctttaacaaagcctgccccaggatggtacaggacctacgtatggcctattaccagacaagaaaacttcctggctgggcgcagtagcttacacctgtaatcccagcactttgggaggccaaggcgggcagatcaccagagatcaggagttcaagaccactctgtccacatggtgaaaccccatctctactaaaaatacaaaaaacattagtgaggtgtggtggtgtgcacctgtagtcccagctactcaggaggctgaggcaggagaatcgcttgaacccagaaggcggaggttgcagtaagccaagatggcaccactgcaccctatcctgacaagagcaagactccgtctcaaaaaaaaagaagaaaaagaaaaaagaaaacttcctaaaaactgatgtgtttttattggtcgagtctgcttacttcagattacagatgattttaactaaactaaaaaccaacagtttcggatgctgaccctctttgccctgtcggctgagctcaatgaccgacttgtccaggcacaagtagcgatgagtatgtgctgcagcctgctcataatcttcactcctcaaagcagtctgaactccatccatgcagaacttcaggtccaagatgtcatcagctctctgaatggcctgatagaggcggttctgcaaaaagatttggtacttacaaacaatgtcctattctttcaaaaacacccctcaagaaggtagggagattcaggagctgaatctgatcaaccatatgtcaatagcaatctcacaaacaccaccactactgttaacgcaactgttattgatgatgatcaagaccattgacagatatcatacaatgttaataacgtgatcaaatcattctctctttttttttagacagagtctcactctgttacccaggctggagtgcagtggcgcaatcatggctcactgtaacctctgcctcctgggcctaagctatcctccacctcagcctcccaactagctgggatcacaggcatgtgccaccatgcctggctagtttttgtattttttgtagaggcagggtttcatcaatgtttcccaggctggtctcaaactcctgagctcaagctatccgcctgccttggcttcccaaagtgctgggattacaggtctgagtcacagagcccaactttttttttttttttcttcttgagacagagtctcactctgttgcccaggctagagtacagtggtgcaatcttggctcactgcaacctctgcctcctgggttcaagcaatcctcccacctcagcctcccaaatacctgggattacatgtgcacacaaccacaacctgctaatttttgtaatttttgtagagacaaggttttgccatgttgcccaaacccaggctggccctgaactcttgagctcaagcaattcattctcctcggcctcccaaagtgctgagattacaggagtaagccagcacgcctggcctacttcattttcttacctaattgccctggatagaaccatacagccaccaactcactattaaggtttttttagaacatgcttgcgccaggcgtggtggctcacgcctgtaatcccagcactttcggaagccgaggtgggtggatcacgaggtcaggagtttgagaccagcctgaccaacatggtgaaaccccatctctactaaaaatacaaaaattagccaggcctggtggcgcatgcctgtaatcccagctactcgggaggctgagacaggagaattgcttgaacccaggaggtggaggttgcacacgctgagatcaagccattgcactccagcctgggcaacagagtgagactctgtctcaaaatcaatcaatcaatcaatcaataaataaataaaacatgcttgcttgttctagagacatagtaagagaagacacccttgtcttgttcctcatcttagggggaaagaatcacacgtttcaccagtaagtatgatattagctgagggttgtttttttaaaaaatttttgtaggacagggtcttactgtgttccaaggtttggtctccaacttctggcctcaagagatcctactgctttggtctcccaaagtgttaggattgcaggcatgagccaccacacctggccagctgtggtttttcacagatgctctttatcaggctgagaagttcccctctattccaaatttgttgagtgtttctaccacgaaaggatattgaattttgttaaatgttttcttctgagtctatgaggtgatcatgtgttttttgtccttttttctattaatatggtgtattattaggatggtgcaaaagtaattgcggtcttggccactacttttaattgattttcagatgttaaatcaaccttgtgttcctaggataaattccacttggtcatagtatataatcctctttatatattgctagacttgctttactagggttttgttgagttaaatttttttttttttttgagacagaatctctctgtcgcccaggctggagtgcagaggcgccatctcggctcactgtaagctctgccttctgggttcacgctattctcctgcctcagactcctgagtagctgggactacaggagcctgtcaccaccactggctaattttttgtatttttagtacagatggggtttcacggtgttagccaggatggtctcgatctcctgaccttgtgatctgtccgccttggcctcccaaagtgctgggactacaggcgtgagccaccgcgcccagccttgttgagtacctttatgtctatattcataagagctactggtctgaagttttctgtgatatttttgtctggctttgttatctcacattagatttctattgaatggtgctcttctaatctctaatgtggtagcttttttttttaaatagaagctggtatttattaacttatttatttatttatttttaatttgcaactccactctgcaactcaggctggagtacagtggcatgaccttggctcactgcaatctctgcctcttggggttaagcgatcctcctgccttagcctcccaagtagctggaattacaggtgtgcattaccacacctggctaatttttgtattttttagtagagacacggcttcgccatgttgcctaggctggtctcaaactcctggactcaagcaattagcctgcctcagtctcccaaagtgctgggatacaggtgtgcaccaccatgtccagctaatttttgtattttttgtagagatggggttttcccatgttgcccaggctggttttgaacttctgggctcaagcaatcctcctgttctggcctcctaaagtgatgggattgtaggtgttagtcaccacgcaaagccccatagacattttgatgttgtagttagtagagggcagtaaagaagctattggccaggcaaggtggttcacacctgtaatcccagcatgttgggaggccgaggcgggcagatcacctgaggtcaggagtttgaggccagcctggctaacatggcgaaaggtggaaggataacttgagcccaggagttcaggaccagcccggggaacatggcaaaaccccatctctacaaaaaatacaaaaactagctgggcatagtggtggatgcccgtagtcctagctcctcaggaggctgaggtgggagaattgcttgagcccagggagttggggctgtagtgagctgtcattgtaccactgtactccagcctaggtgacagagcaagaccctgtctcaaaaaaaaaaaaaaaaaaaaaaaagcttgatgtattaccttggccaggtcaagctgacgaactttgctggacacattctcagccaggttgcaggtaaaggtgatcattccagccagctgctttgcatctccctcaatcagctgcagattaggactggagaaatacattgttagcatacacataacgatagggcagagaagagacagaaacttttttttgcatatggacactatgtcttctacttctttcatacctacctgtaactcttagctcagtttgctctatactcagctttttctcaagaacgtttgactgtaaactcagacctatacctgataaaaaattaactcttttttttttttgagacggagtcttgctttgtcgccaggctggagtgcactggcgcaatctcagctcactgcaacctccgcctcccgggttcaagcgattctcctgcctcagcctcctgagtagctgggactacaggcgcgtgccaccaagcccagataatttttgtatttgtagtagagacggggtttcaccacgttggccaggagatggtcttgaactcttgaccttgtgattcagcctcccaaagtgctgggattataggcgtgagctactgcgcctggccaaaattaacttctaaaaccaataaagacacacctaaataggtacagtcaaagaactagagaacaaattctctcaattgctaagtgagcataagatgcactaaccagtaccatgtgagaggatggtgagatcaaggaacaatttttgtttttgtttgagacaggttctcactctgccactcaggctagaatgcagtggcacgatcatagctcactgcagtttccaacttctgggctcaaatgatcctcctgtcttagcctcctgagtagctgagactacaggcgcacaccaccatgcccaactaatttatttatttatttatttttatttttttgtttttgagacagggtcaaaagtgatcctctagatgaggcctcccacagtgctggaattacaagcatgagccactacacgcagccagggaacaatttttatgactaacaaatatacccagtctgtaaaaatggtggttctcggccgggcatggtggcttactcctgtaatactaacactttgggaggccaggcgggcggatcacttgaggtcaggagtttgagaccagcctggccaacatggtgaaaccctgtctctactaaaaatacaaaaattagctgggcgtggtggcacatgcctggaatcccagctactcgagaggctgaggcaggagaatcgcttgaacctgggaggcagaggttgcagtgagccgagatcatgccactgcactccagcctgggggacaaaaacgaagctccatctcaaaaaaaaaaaaaaaggtggttctcaaacttgagctgtgcattagaatcacttggtaggcttgtcaaaacacatcttcctggaccccacccctagactttctgattttgtaagtttggagtggggccctaggatttgcatttctttttttttttttttttgagacggagtctcgctctgttgcccaggccagactgcggactgcagtggcgcaatctcggctcattgcaagctccgcttccccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccgcccgcctcggcctcccaaagtgctgggattacaggcgtgagccaccgcgcccggccaggatttgcatttctaacaaggtgtgatgctggtacaactggtccaaggactgtttgaaaaccatcaaactaatacccttaggtgttcactttatcttgagataataccctttacatttcaagctgaactggtgtttataacagaaagtttaaaaaatggtcacttgtccaattgaccctgttggaatttacattagctcttgctgagatgcacagactcaccccattcggtggagagtgaccatcttactttcaatggtgttttgctgttccaaaagagcatccagctctctctccaccactttctgaaacacagagaaacatcctgtcagcagaatgatcagaaggaaccttaagagttatctaatccaatcacttagctgaagggtgaatctcatttccaagtccttttttccttccactatgttctccttagactttaacaatgcttcattttgcacttatgttgcatgattgttatcttacgtatatcttattccacctggcagatgagcaccataataggaagaaataaacttttaatcagtatcattagcatagtgcctaatacaggaaggcatttaaaatacaatgcctggccagcactggatcccaaagtaatcccagctctttgggaggcccaggtgggtggatcacctgaggtcaggagttcatgaccagcctggccacatggtgaaaccccatctctactaaaaatacaaaattaggctgggcgcggcggcttacgtcggtaatcccagcactttgggaggccaaggcaggcggatcacgaggtcaggagatcgaaaccatcctggataacacggtgaaaccctgtctctactaaaaatataaaaatacaaaaaattagccgggtgtggtggcgggcgcctgtagcccaagctgctcaggaggctgaggcaggagaatgacatgaacccggggggtgggggggggggggggcggagcttgcagtgagccgagatcatgccactgcactccagcttgggcaacaaagtgagactccgtctcaaaaacaaaaaacaaaaaacaaaattagctgggtgtggtggcgggggcctgtaatcccagctacacaggaggctgaggtaggagaatcacttgaacccgggaagtggaggttgcagtgagccgagatcgtgccatttcactccaacctgggtaacaagagtgaaacgctgtctcaaaaaaaaaaaaaagaaaatacaatgcctaaacaaaaaacaccacacacatcttgctgaaatgaaatttccagtgacagttaccaaaatttttcttcttggtgcatagtcagtagccaggggttataaatataattatctctcattcaagccatttattgtgcaacctcaatttatgtaacatttttatgcttcggttttttcatctgtaaaactaggatagcaataccaatctcactgggctgttgaatgagtcaaacaggaaaccacacaaagtgcttaacatggtatgtggcatatagttcaacaacagccattaaaattaaccatacatttttattttttgcgggggctcaagtgctcttcctaccccagccccccaaatatctgtgactataggcgtgcacaaccctggtccactgtttaatttttttgtagccacgaggtctcactatattgcccaggctggtccccaactatctgctattgcccaggctggtctccaactatagctcaagctatctgcccatctcagcctcccaaagaactgcgattagaggcatgagccacttgtgcccaggcagctatacttttttttttttttgagacgagtttcgctctttcacccaggctggagtgaagtggcctgatcttggctcactgcaacctccctgccctggggttcaagcgattttcatgcctctgcctcccaattagctgggattatagacgcccaccatcacacccggctaacttttgcatttttagtagagactaacatggtttcgccacgttggccaggttggtctcgaactcctgacctcgggtgatccacccgcctcggcctcccaaactgctggtattacaggcatgagacaccaagcccggccatatacatttttattaaaatcgttctgtaggttccagaggaaaacgtcctcttgacagtcatggaatacaaatacagtacttatatcattttgtctgtaagatttccataattttccacccaacatattaaatgactgaatgaatgcgagcttaggaatgttaagtcaagatactaaattttttttttttttttttttgagacagagtctcactctgtcgccgaggctggagtgcagtggtgcgatctcggctcactgcaagctccttctccctggttcacgccattctcctgcctcagcctcccgagtagctgggactacaggcgcccgccaccacgcccggctaattttttgtatttttagtagagacggggtttcactgtgttagccaggatggtctcgatttcctgacctcgtgatccatctgcctcagcctcccaaagtgctggggttacaggagtgagccaccgcgccaggctttttttttttttaagagacacaattttgctcttgttgcccaggctagagtgtaatggcgctatcttggttcactgcaacctccgcctcccaggttcaagcaattctcctgcctcagcctcccgagtagctgggattacaggcatgcgtcaccacacccggctagttttgtatttttagtagtgatggttttcaccattttggtcatgctggtctcgaactcctgactcaggtgatcctcccgtcttggcctcccaaagtgctgggatggcaggcgtgagccaccgcgccccgcaagatactaaattttaaaacacatcttgctgaggccagacaaaaaaagccccacacactaaactagccaggcacggtggtgtgcgcctctggtttcatccattctgattgcagcacaacagcactccagcctgcgcaacagagagcggccctgtttctaaaaataacaaaacaaaacaaaaaacaccacacacatcttgctgaaaaacgtatcagaaactgctagagttagtgcaagtttatacttgaaaatactcaaagatatcaacgatcacctctccctcaggctgaaactgccttttgtgctcaactttgctagaagtttggtctgggaaacagctgacaagcttagagcttagatctcttttgactagcaaggaacccaactgacattcgaaagtgaattgacagcatcgagttgccactgaaaattaaaggaggcaggaaatagaacgttatgaactgaaaggaattggagaatagtccacacccctcatttgataaaatatcaagggtaccagagatgaagtgacttgtccaagattagagaattgtgtctgagtcttaaaagctaaacctctacaaagatgtgcatttgaccaaaacgctaaaatcacacccccaaatcactccccacaagaggaagtcttaaaacgcttcaagaagttaatctgcaaaggcttccctcttaaataacaggatgagagcgtttcataatttgtaaattaagccaatgcaaaagggcgcttattattttgagaaccaagcaatttggcaaatactctcagactaactttactcccgtggagaaactggtgatcatggatcagggaaatcaacgggggtctagggaggagaggctgcagatcgcccaggtatcagggaagacaagctcggcgcgtccgacagcgtgaaaagagttgacaggactactcatatacccgactagcttccgcttctttgttttcccgcttttttgtatcccccagcaaggagagtttcccacagcccggatttcccgactgaaggctcccactctccctagatcctccatgaaaaagaagaggctcgaccccgcacctcctcgccgcagagccgttcgtatacagcctccagctcctgcagctctgtcagggagcgaatgagctcagcggagatttcggagcagcggccacctcccaccccctcagacggctgctgcacccctgacagcttcggaggcgaatcaaggtccgccatcttggtccccattcggcacttcc

SEQ ID NO: 355 - DNA, 42986 bp, Homo sapiens; identical to SEQ ID NO: 354
  source 1..42986: mol_type = genomic DNA

SEQ ID NO: 356 - DNA, 14021 bp, Homo sapiens
  source 1..14021: mol_type = genomic DNA
actgctcttccagaggcaagaccaaccaagatgaggtgggtccacagctttccctcctgcctttcctctggttctttatttcagtcttttttgcatacattggtacagatgcagaaatagaacaaagaaacagggcaaatgggctaaattatagtgaaccaaagggcttagtgtgttaaatcttctccttttctgcatccatagaagacagtgctgctgtctttcccaggagataagatttactctcaggagtgtctttttccttgaggttacgtttttgtctttgtagggtatgtcatcagctcccgtggtaggcttcctggcattcggaatatatttactagcagatattttcctctttaaaaatgtataataagaaagactaatagtaacacatttgaatgacacaattaattgactagtacttgggatacacactagtacctgggatacatctaattaagacacttagatcttaaaaaataaaaagactttttgaaatgttgaaataataagactagaaacttttttttttgtgagacagagtctcactctgtcaccaggatggagtgagtggcgcgatctcagctcatcgcaacctccccctccccggttcaagcaattctcctgcctcagcctcccaagtagctaggactacaggcgtgtgccaccacgcccagctaatttttgtatttttagtagcgatgtggttcaccatgttggcccggatgatctcgatctcttgacctcgtgatccacctgtctcggcctcccaaagtgttgggattacaggtgtgagccaccgcaccctgcctagaaactattttaatagaagcaaatagtgcctgaatggtgggcgtctgttagcgagatggtgaactggcagatggcgcctgtgtgtcaatgcccatggccaccgtcctgctttcagacaccagttctcttccaggtaaccttctggcattttggggtttgagataccatttcctaaaggtgaattatcacaaaatactagaaataaccacataagtgtttaaaattattgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacattcctgcactttgcaagttagccaaccgggttcggattgtgcagtccaactccagccaatggagtcaggacacagtagcagggacaagctgcgttagacataaaaacctctgctttcctttgtttagggtgctctcgtggcaaccagacttaccaggagctctattctgcaaaagtaaatttgccttgctgagagaccctttgtcctttggctcagtgttggttcttctttgcagcaccgagcatttgtttccaacaaatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctggtggttaactataaataaaaatgtgaattagataaactacatttattacaaccaatgatgatttttttttttttgacggagttttgctcttgttgcccaggctggaatgcaatggcatgatctcggctcaccacaacttctgcctcctgggtccaagcaattcttctgcctcggcctcccgagtagctgggattataaacatgtgccaccacgcctggctaattttgtatttttagtagagacagggtttctccatgatggtcaggctggtctcaaactcccgacctcaggttatctgcctgcctcggcctcccaaagtgctgggattacaggcatcagccactgtgcccagcctatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccaggtgggatcacaccaaaagcactacaaggtcttactgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaaagaaaaaatactgtaaaatatttaacagggggattgttaaatacagtaagaaattcttcttcaaaggttcagcttgcttaagtttccttgttctttgctccctgctttcaaggccagacttccttactctctgtgttctccctgcgctggtaaacaaccttcccgccagtcgttatctatagagcccacattccacatctgctacccactctgtgaattacccctcccatcacaatggcttctcccggcaaaactgatcttcctgccttcccagcagtgtaatcacattcctgcacttttcaagttagccaaccgggttcagcttagattgtacggtccaactctagccaatggagtcaggatacagtagcagggacaagctgcgttagacataaaaacctctgctttcctttgttcggggtgctctcgtggcaaccgaacctatgaggagcaaccttatgcaaaagtaaatttgccttgctgagagaccctttgtcctttgtctcagtgctagttcttctttgcagcaccaagcatttgttttcaacaattatatatttaaggaatctttgattatggaaaatttcaagaagtagagggaatagcatactaagccctctgttcccatctttgagttatctacattttattagaagtatctttggggtgactgagggaggtttctctttcctggagggcttctgaattattgccaatgtaccttcctgactgcagccagaaactgaggcccctatacctatgtacctttctatccctctctgaagcttctgcagaattcccagcaagacagagcttgctggaagcttggtatgctcagaagcagctaaagcgtgtatgtggggcggagggtgggggcaacttcttggtcctagcacttccatatattgattttcttttctggctgcttagtgggaggagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtctgcattctttctttgagaacacacagttccccattcttatcctgacctctgggctttcaggactgccaagaacattggggatcctgccagaaatgaggggagcttgagctttcgttggcttctatttggggtagaaggagattgatgtgcagagcagcttccactcatctgacttttcatgggtctctgggaacaatttccaaatggtaaactctctggcttctctctctttgcagatgaccgcttcccgaagccccctgagattgcaaatggctatgtggagcacttgtttcgctaccagtgtaagaactactacagactgcgcacagaaggagatggtaagacctggacaactatctctgtgctctacctacaacccctgctctgacatttccatgatgggtggtgctgaggtgatttgccagaaagttcgttgctctccttggagccaggagatttagattctgataagcgttttgtcgccagtagccatggccctttgggcagactaacttttgtcagcctcaggttttctgttttgttaaggggaggtgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatatttatttgctcacttagtccttacagtttcccactgaatagaggttattattctcactttgctgataaggaaacagaggcaccgacaggttgagtatcttgcccaaattcaggtggcctgtaagaggcagagtcaggatttgaaccctgagccctccctgtactgcctggctgtgaccgccatcaccacagtgtgttctgctgggcttaactggtgtccaggcacttggcttccagcacagcactctttcccttcctccttctcgtattctctctcctttctcccttcctgtctgcctcctttcttcttcttctttttaattcttctccttaaatgccttctcactctgctctgggtgcagacttgacttttcctttggctcatttcttgccttttgtttcaggagtatacaccttaaatgataagaagcagtggataaataaggctgttggagataaacttcctgaatgtgaagcaggtgggtgctgagcactgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaaggatcaccagggtcttgttcattggggcctgaagggcactggctgaatccactgtcggcattgcccacagatcaggagagcctgtgcatacagagagcctgctagagagccctgggtctaaggagaagcaagctccagggagaacaagtcaagggataacataaaatcttaatccatggaagcctagcaggaggctggacatgggctggaactcctgcttctcgttattaggaggaactgttgctctctcctttccgtctcagaaccagaggcaaaggcccagcctcttctgctgtgagtggtgtggaactaccaacctgcctcgtattaactgcaacatctataaagtatgagctccagccaatgctgctctagattcctctttcttcagagatgatgaattattgtagctcctagccctttcttttttctttctttctttttttttttttttgagacagagttttgctctcgtcgcctaggctggagtgcagtggtgctaattcctgacctcaggtgatccaactgcctcagcctcccaaagtgctgggattacaggcgtgagccaccgcatctggcccctagccctttcaatgaatttcagggaattgtgaaaattcctttgttgagataattgtttaaatataatatagttcaccagccaggcctcaaaaaactcagtatttctcatttccttatttagaaatagagctttttgtaatgtaaacaattaaaaaaattattttaaaactgcaactattggaaatgagatcagcaggtggtaaggacaaagcatttaaatctttccagtttatgcagcagtgacagccgccaatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 357 - DNA, 6225 bp, Homo sapiens
  source 1..6225: mol_type = genomic DNA
gcccggaaacggaagtctcgttctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcaggtcctggtccgcgccagagcccagcgcgcctcgtcgccatggtgagtacagtccctgcctggcgccttcccggggtgggctcgtggggccccggggcgagggcgagagagcctcccaaggatctcctgaggccgggagaagctggtggactgggccatcgccgggagacgtgtctctttcctctctgttcacccgcttcctttgtgttgcagcctcggaaaattgaggaaatcaaggacttcctgctcacagcccgacgaaaggatgccaaatgtaagtggttgctccgaaggttcaagaagagcggtgcctagcctggcaccgctccgggagcgtcttccccggaatgtcaggcaggagacggttaggccgtctgggtgtgtgcctggccctctgggagcagtggtttcatcctgtttcccatgagaaagacctgtggggggcacgttgaggccctggaatttctaggaccatctttagctaatcgcgatcatctcagaggccgccctgagttcagttttctttcgtataatatagtaaattgtcggaacggaatctccactccgcgaaagcctcaaaacacacgtcccataaacactgtttaggttctctgcagttgtgcaaaatcttaacacaaaatccattttgtaataaagtgctggatatttgcatgtaatgtatcgagcacggcacactgtgtagtatggtcgtttacctcgtgatcctgtggtcgctggccagtgtcagaaggtatcatacctatctaatccagaaaaatatttaaaaaaatttttttttttctttgagacagtctggctctgtcgcccaggctggattgcagtggtgcgatcttggctcactgcaattaccgcctcccaggttcaagcgatccccctgcctcaaagtagctgggcgcgccaccatgcctagctgatttttgtgtttttggtagagacagagtttcaccatgttggccaggctggtctcgaactcctaacctcagatgatccacctgcctccgcctcccagagtgctgggattacaggtgtgagccactgtgccccgccaagatcaaaatttgaagcagggcttctactgaatgtatatcgcattaccaccattgtaaagtcacagagtttaagttggactgtcataggtctgtttcccagcttgtacatacaggggaaagaaggtgattaatgaaaaaccttaaacagcaggttttcgatggataggtgccaatctctgctgcccacttacttaaatttttacaccaagtgtgagaggtagttgtgttactcctttgtgatacttgaaggagattgggggggcttgtgtttgatacaagctaggtcttgagttatgttgttactttaacccagtcatcttttttcagctgactgagaatcaggtcacatgtggaagtgaggttgcatgggacaggcctgttaaggtgggctaagacaccagccgtctctaatgctctgccagccgtggtgccagacggtggttggtgtacagggagagtctttcaatgagttgggggtaggcagagatgggggtcatatttgtgtccccattacccaaaacaggctgtcacctttgaggtagtgaccacctgtggggacaaatagcatctggtgggaatgatgactgttggctagtgttttgtgtaaagagatgaggttatcaggtcagttttatttcagaccatatggggtcactgcctagtttgaagcccaactctacctgcaggtaacttacccttctcagcaagttaaacacgacaccaccgtttgattgtgttttaaaagggtggtggtccgggcgtggtggctcatgcctataattccagcactttgggaggccaaagcggacagatcgcttgaaccaggagttcaagaccaacctgggcgacatggcaaaaccccatttctactaaaaataaaaaaattagccaggcatggtggcacacgcctgcagtcccagctactcaggaggctgaggcaggagaatcagttgaaccaaggagacggaggttgcagtgagctgagattgtctcactgcactccagcctgggtgacagagcgagactgtctcacaaaaaaaattgggaaccttcattttagatgatgtggctttaaaggtagtggtcacagtcccctggggacagtaaagtgtcagtagctgtttgttgaaaaaactttttaaaatggttgtattaatttttaacgtgtaataggcatagcgtaaaagttaccatttacactgggtatggtggttcccatctgtaatcccagcactttgggagactgaggcagatggatgagactagcctgggcatcatagtgagaccctgtctctataaaagaaaaaagttagccgggcgtgtgctggtggtcctagctactcaggaggctgaggtaggattgcttgaatccaggaaattgaggctatagtgagccacgattatgctactgcactccgggctgggcaacaaagcataattgtacagttcagtggcattcagtaaatacacattgttgagcagctgccaccatcaccgcccatctccagaactttatcttcccaaactgaaactccctctgttaaacaccagctccccattcttccccagcccctggcaaccaccttccaatttgtccctgaatgtgactgctctggataccccatacaagtgggtctgctattgcatatttgaccttttgtgactggcttctcttcacatgtcctcaagcatgtgtcagaattgccttctgttttttctttcttttttttttttttttttttttgacatggaatgtcactctgttgcccagactggagagcagtggcggaatctcagctcactgcaagctccgcctcccaggttcatgccattctcctgcctcagcctcccaagtagctgggactacaggcgcctgtcaccatgccgggctaattttttttttttttttaaagtagagacggggtttcaccgagtgagccaggatggtctctatctcctgacctcatgatccacctgccttggcctcccaaagtgctgggattacaggcgtgagccactgtgcccggcctgcaatttgctttttttaaacagggtctcactcctgcccaggctggagtgcagtggtgtgatcatggctcactacatccttgatctcctgggcgcaagtgatcctcccaccttagcctccagagtctctgggactacaggcatgcgccaccacacctggctaatttttggtgttttagagatggatctgtgttggccaggctagtctccaactcctggcctcaagcagtcctcccaccttagcctcccaaagtgctgagattacaggcaggagccaccacacccagaccggagttttcttttgaaggccgagttttccattgtgtgggtaggccacggtttgtttattcgtctattgatggacattgggttgcttctacattttcgctagtgtgaataatgctctgaacatgtgtgtgcaaatattcttctgtggttgctatctgttctttggggtatatacctagaaatggaattgctgcacatatggcaatgttgagtaaactttttttttatttattttttttttgagatggagtttcgctcttgttgcccaggctggagtacagtggcggaattttggctcactgcaaactctgcctcccatgttctcctgcctcagcctcctgagtagctgggattacaggcgcctggctaatttttgtatttttaggagagacggggtttctccatgttggtcaggctggtctcgaactcccgacctcaggtgatccacccacctcagcctcccaaagtgctgggattacaggcgtgaaccaccgcacccaactgaataaacattttgaagagctccatatgtctttacaagtggtgttcagcttagttcagctgctaggggcagtgttatactgaaataggttagtttggatgaatatccaggtgtctggatgtattaagaacgagagtccaggcagcccgtgccttgggcaggctctgagtcacagtgctgcttcctctgatgtgccccattcctatagtagttactggcagaaatggagttgccgaattgctaggacaagatcatcttgtgtgcgtctgccaggttaagtgctgtgtgctgtgtctggccaggtgctttcgttgaagtgttagagcccatgttcagccctcagccacctgcttcttgattggcacatcactgctattataacaaatcctgggagtatctctgagcagtttttaaagagttggaacaaggcattcagtgaatacatggagtggtaactactcctgggaaggggttgtctcacagcagccagatggccatgcattgatactgctagtacataaccagagtggtgcacgattcaaaccccacacagctgaatttgaggtacacagtagctgtttcttgtctgagccatgatcctgaaatagaacttggcagcaggaaagaacccagaaaatggattccacataaattcaaggaaaaccctgggtgcgtgttgtgcgcagtggctggaggcatcctgaagaacgagctcttactggcccagaatgtcatctcacatgcggaggcctgatttccgggagtggagtgctgaaaagcgctcagtcccagcagacagcccgtctccttactttatcactgcttctatccctttttaaaaagataataggccaggtgcggtggctcatgcctggaatcccagcactttgggaggccgaggccagcggatcacgaggtccagagattaagaccatcctggcaaacatggtgaaaccccatctctactaaaaatacaaaaaattagctgggtgtggtggtgcacgcctgtaatcccagctactccaggaggcttaggcaggagaatcgcttgaacctgggaggcggaggttgcagggagccaagattgcgccactacactccagcctggcaacagaccgagactctgtctcaaaaaacaaagtagaaataagaaagataataaggttgatagaagatattctgtaatgttgtgttcagtgtacccaataaaagtcccaagttggaggaacgggtaatagtgttttctgtttgcacagagggatggtactggaggtgggtgctgtctcctgcatgctgcttactgcttgagtgtatttgcacatggactgtgtcacatctgttttctgtgatacaatttaattcctgattctggtctccggtagctgtcaagatcaagaaaaataaggacaacgtgaagtttaaagttcgatgcagcagatacctttacaccctggtcatcactgacaaagagaaggcagagaaactgaagcagtccctgccccccggtgagtgagcctgaagtcacttcaggggcgggtggggtttggaaggttgctgtgtgtggccatgttgtatcttgttttgaatccctctcagatttcagagcccattttatggtctaagaatctgctcttgctgttgggagtgtgaggaatagttgtgattctcagattatatacagtaccagaaatcatttccttagccagaagagcggttagagctcatttaatcctgttcacgacccttcgaggttggtgctagtactgatagtccccattttttacaggggaacagatgaaatataatagaccaagtctttttatcgaatataatagaccaagtctttttatcaaacactaaatattttaaccgaaacttcgctggtggatctaatttctgaaccttgtgtgctctctttagcttaagtacaaaatttagacaagcagcagcaactcagatgtgtcttctggatggcttacttttgtctctttccctctaggtttggcagtgaaggaactgaaatgaaccagacacactgattggaactgtattatattaaaatactaaaaatcctaa

SEQ ID NO: 358 - DNA, 6225 bp, Homo sapiens; identical to SEQ ID NO: 357
  source 1..6225: mol_type = genomic DNA

SEQ ID NO: 359 - DNA, 3326 bp, Homo sapiens
  source 1..3326: mol_type = genomic DNA
ttctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccgaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctggggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcaggcctccagccttctggggctcccttgccccgggttcaaagtcagtcctcggtgaccacccactgcctaggaggcaggcccttcccacctggggggcctctgagggcaggggctgtaaaagcagctaccagaagagtccactttccccagcaactgcagggactgagtcagagaccaagaccttttaaaaggaggttttcacccaaagaagttccctcccctgccgcagtctccaagctgatcgcctggctcctgcagttctccggctccctgtcctgttctggaacttgcttgcttccccttccactggccttagtccctgatctcacagggtcctgttccttctgcacagaggcctcccccagcacccccctctttgactcccgatcatccttcagctcatgtcactgtcctttgggaaacaaccctgacgcccaccttccatcccctctccctacagcagggactctgacatttcacaaggcctgcaatcgctgtttgcaggatacaagtccacctcacctcgcctactaggctgtagacgccatgcaggcgggaacgtgtgttttatccattactgtatcctctagaacagagaacgtgctcaagaaaatttgttgaaagacaccccaatgagagaagaatggctgtttccagccttccgggcccctcagctttgggctcctgcagggccccagaaccgtgggatcacggccacgaggagaggccccgaggccaggacttcctctaatggacacagggcctttgagcaccgggtgactggggccccactccccagcagccatatgtgtttgcgagcgttttcagtcggtccgcatccacccggtcccttcagccagaaccctaggagccccgccccgtcctcccggggctcctttctcacccgcgtccctgccgcggtggatacgcacccctcaggctggctgcccagcgcggtttccacgcccaatctgccgcgaccccatcactccaccgcacctacccctgactcctgcttgtcctgcagcctgggctcctccctccgctggccaagtcacgccaagcagtttgcggttacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgatctgatcataaataagaagcagccc

SEQ ID NO: 360 - DNA, 48462 bp, Homo sapiens
  source 1..48462: mol_type = genomic DNA
ttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggaggtaagtttacgccgccccagaccgcagccacgcgcgccccaagtccccgcactaccccctctcccctcgagagcctgcactttcccacgtgcctctcagaccccttctctccccgcgcagccctttcccgtctcccctctccccttttcccccaccctcccaggcccgtggcccgcgtcccctcctgtctgggaacctgggggccgggaaaactgaagagatcagagtgaagcgagcgtggggaaggggaggaagggcgcaagaccgcctgcggggtgaggggctgaacgctgagcgggcagggcggcgcgggggaggggtaaggacaggggcattcgtctcggggtaatcctggcgcgcgaggtgcggggatgctgaggggtgccccgaagttttcgaccgtctgagattccaagatggggcgctctctttccggggctgagtggcctaggaaagtttggcagaaactgagtagagtctcccgagtcggtcttcgcagcacccctcctccccagccccggcctgcagggtgggagtctcagctggaaggctgcagggcttggggaagcggtgtgggtcacttcccctctagcgcagagaacccacagctgcttgcgcttgttccagggaaggaaggtggcctccgtcagcccatctcacactgttgtcctgaggacccccttgcattgacagtcagcttctctgtgtcccctggtcctagactggcccattcctgttcccccacgcccctctctctacctcacacctttaagccctgaatttctggcctagggcagtcactcccggcttccccgccctttccctactctgctgacccttggcaggattctgcaccccacaaacagggccagggctccccagacctccctgcccagacaaacaaagctgcagaatctcccagcccgtctcaggtctggtcacgcctgctctggccccgggagcccacctgtatcagttccttgtgttgggtcaaagattctggggccagtggaccaggatgaggtccatttattcagagccaggcgcccatctcaggactttggcccccggcggcctctccctgtgtcaagttctccagatatgggacagatcagggcaaagcagggcctcttggagggaatcctgatccagtgtgaggtgcccaagcgccagtgacagggagtctaataataacccctgacgacccggctgccatcaggcccaggcagatggtgcctgccctaccagagggaggggagcatcaggaccccttcctggggttcagtgggcactcaggagcaagacggcagtcggtggacccacccccctcccccagagcccagcctgtgggagtctgtgttccctgagaatgtggctgcctggggatagctccagggaatcttcctctcccagagaatgcatgaaaagaggcggatatgatttcagaaacagccgtgtgtgtgtgtgtgtgtgtgtgtgtgtgtgtgtccccatcccaaaccctgtgccccacatcccacacccggggtctccagccatagttttctcctctccactggaggaaatctaaacttttcattgggtcaagaagacccctaggtgggggtagggatggtaaggggactccctcaccctgatggccccagagacagttcctatcagcccaacagctgtggctggtggatcctgggcctgcccacagccccctcagtcccatgggcaggtggcagttgagccagatgaacctacctccagcctctgcccctcctcccaggattctggccccggctcactttgtgctgggcatcaaatggttccagagggtgtcccttcccatcggccactgctcctgggcagctgacaccagccctgcccactggctcctggtcccgctcaccccctcaccaccactcagatcgctgagtaggagatgagcgtggtgggccaggaccggaagtctggctctgggtgttatttaaggtggctcctgtttttggtaagttcccctgttgtgaccacaggtctctcctggatgtcttctttcctcctgagcaccagtcactaacagagtcaggtggaccgtcggtcatcccagtcttcagcaagcttgactggagcaagtgctatgccaggcgtggggtgaccgtggtaaccaaggcagcaggtcttcaggagaaattgctggggattttctgcggctgggctctgggcgcagtgctatggcagacaccaagcagtttgaggtggggctctgccctccagttggctggggtggattcccagttctttccatgtgtgaccacgggtaggtgtcttaacctctctgagccttgttcccttcatctgcaagaattagatgagatattccacatatcatgcctagtacagagagtcccatagcacataacaggagccagtgacacagatcattcaatggagtggctgagaggttcaggagtgtgtctcaggacagtaccctgctggggaatggagaggaaggagatctcttccacagactctgattgggggagactgaacaaaacgcctgcagaaagggcttcagctcatgccccacatgttcaaatgcacagtgctggctgtgtggggtgtggggggtgggtgcgtgtgcatcagagactaagcaaggatggaaacaggcaggtgctggccttaggatgtgggtggtgcgggggatctcaaaggcaagggggttcttggaagtgcagagatggtgaagagcaggtcacctggtgagctgggatttcctgagcaagttcagtgttccagaaccttcctgaggaagtaggggctctcactcactttctggggtgtttgggagccgtgaaagcccccagtcctcctgatagttgatcctcacccctctccccccagtgaacttgagcccaagtcctcgcaaaggccacttggcctgtgtcaccagccttgtggggaggctaccctccagtgagtagaggcatgagaggtgagcaccaaggcagggctgtggacgagggcaccttggccctggcgggcacccagctctgggctgccagatgtggctgtatgtctggaaggaaatcagcctagacctgcagcccaagtcttctcacctttgacagatgagggggattggatttggagacgattcctactctaaagagatgataaaagaactaatgagttcatggattatgaagcctgtggccagtgcctggcacactggaaactgctacaatcactgcttaggaaggagaagactgcagccagccggtgtccactgggcagtgttggggagaagggaatgggcacctggcactgaatccagcaatgtctctctgagcaaatgaacgaggcacttcggtgtccctgcctgagcgtgagtgccaccatcaccatccagccagcccctcaggggagaccagacactgatgagctcagttcttgaaacatcttagtaagctcccaaaggctgtgcaaatgttagttattgctactgtcaacaggcaggtggccacatgtgtgcttcctgttccagcttcccttgcccaggatcagccgaccagctgctctttggggacatgtgttaggaggcagaggagatgttgttaattttttttgtatttaggcatgtatttccacgtgttctctcattggttggttccgttcatagattcgccaaagtacaaagtggagggtacacagttggggactggaccggaactacaggacttcctgcttctgacctgggggcaggtctgaggaagaaggaccaggcagcaagcccatcccagccgagatctgagaagagctgaggttgggatgaggaagccccattcatccagtgtgaaattgagtcacggtcatcagacagtcatgccgcgcctgggagagggcttaatctttcccagtgggcctgggagggagactctccctctaggtgctcctagtttccctctcccagcctccccctgagaccggcacacctctctctatgtcttctggggccagggctgttgccccctcccctgcccagtgcagaagccccttgggtcccgctgccatggtcactgcggcccccaacttgggtcccagcttggcactctccgctctgggtttttcatgacacagtgacaaatcagaaataattgaagtccctttgatgaggggagaggcagagtctgagcaccagtgtgggagctgggggcctggtgttgctgtgggacaaggaggtggctgcagggcacagtgggaggcgtggggaggcgtgggaaattgtcttggcaaagctctgtccatctgagcaggggggcctggaagcagaactcttggctccctcctccattcccctccacctccatgcacatggggacatgcagtgttaattaggagcaagaaaataattgcccattaggagcagcaggtgccaccaagctggccctggaagagggtgctgctggttagggggaggggggtgggctcctacctgctcctcttttccctcctccttcctcctcccttgcccaccttccctcttctttcttcttcccttcccaattccttttccccctacaccctctcaccctgtcccacccaccacccccagttttttcccagcacctaggtagggttcccaggagggtttgggaagtaactccctaacaaaaggcttccaaaggctgggcagggtggctcatgcctgtaatcccagcagtttgggaggccaaggaaggaggatcacatgagcccaggagttgaagactagcctggccaacatagtgagagcctgtctgtatttttttttaaaaaaaggaaatcaaaaaaaaaaaaaaatgcctccgagtttgggtttctcaggcctcgctttcactggagctggacagcattatcagaaacctaattgaggccagctgcccagcttggagaggccccaggccacaggggctcagcggctgccgaagggggagaccgggaggctggaggaggcttgagagagtgaaacgggggagcaggctacatcacccacagcctgatccttctcggacgagccttccttgctgggtggggacattggtagattcaggagcttttcccactggggataaaatgatagtgggactgttcaggaggcaaactcaaagggtagctgggggcaggctggatggtaactgggcttcaggctacacaggtttgtctggggctcccttacatttttgtgttattaggaataacttggttgggcgtcgtggctcacgcccgtaatcccagcactttggggagccgaggcaggtggatcacttgaggtcaggagttcgagaccagcctggtccttttgtagtaaaagtacaaaaaaattagctgagcatggtggcacatgcctgtaatcccagctactcaggaggctgaggcaggagaatcacttgaacctgggaggcggaggttatagtcagccgagatcacgctgctgcactccagcctggtgagagagcaagactccgtctcaaaaaaaaaaaaagtacaaaaaaattagctgggcctggtagcacatgcctgtaatcccagatactcaggaggctgaggcaggagaatcccttgcacctgggaggcggaggttgcagtgagccgagattgtaccactgcactccagcctggcgacagagcaagactccgtgtcaaaaaaaaaaaaaaaagaataacttacaggaaagagtgcagtcttaagtgtgcagttcagttcaatgaatttataccctcgagcacctgcgtgcgtggtatgtgtgtgtgtgagcaacaccatcccaatcagatcgtattcctgaccccctagaagcccccttcgtgctctcttgaaatccgcaccctcccaaaggtagcaatgattcggtgattcacatttctctggctactcatgagtatctctgactttgaacttcatataaattaatccatacagttctctgctgttccatgtctggctttctctctcaacctgacttctgggaaattcatcccagaaataccgtcatgtgtggctggtttccttttcatggctgtatagtattctaagactataacacatgttctatatcttttctcttgttggtggacgtttgtgtctttttgggtgtaggctgtgactgctgtgtgaagctgctgtgaacatttgtgtatcttctgagggacacagccctcctttctgtaaagcagaattgctgggtcatggcatgcatgttacacaatgatttgcaatttttttttttttttggcttggttggggttttttttgggaggttgggttactttttttttaagaaatgggatctcagcatgttgcctagcccaggctagactcaaactcctgggctcaagtgatcctcccatcccagcatccccagtagctgggattgcaagtgcatgccaccaggcctcgctggtttgcaaatgattaagaggatccctgggctttagcagagaggcctcaggggctgccaaggggcggccaggacagaacgtggcatttctatccactcctcactcagatggagctctgtgttgcagggctctgctaagcaagtcagtttgaagaaaaagttaagctactggaaaaagtttgagaacttctgttgacactaatccagtgctgcccagactttaatggaatatatgttgcctgggatcatctctagaggcaggtctgattcactagctccagggcggggctagagattctgcacctctaacaagctcccagaagatgtcagggccacaggtcacagggtggtaaactttacttcaaggaaagaggctctcaactcccagctgtcttggcctcctctgcctgggcctgggctgcagggccctctggtgaaggggcatggactgaggaccagaagaggggcagtgactttccaccatctctttctatccctgggcttgctggggtcagtcccggggacaggccatgctaatgagtggtccaggtggggagagccccagccccagccccctgccacactgtgaggtctttgggagagggaggtgcccagatctactgggccctggcttcccagctgccactttttttttttttctagaagggatctccctctgtcacccaggccggagtgcagtggtgcaatcatggttcactgcagcctcaacctcccagtctcaagcgatcttcccacctcagcctcctgagtagctgagactacaggcagatgccaccatgcccagctaattttttattttttatttttttgtagagacagggtctccctgtattgcccagactggtcctgaactcctgggctcgagcaatcctctcaccttggcctcccaaagtgctgggatataggcgtgagccaccacacctggcggaaagccacattttccaaagtcaaatccatctgttcccctcccaagtgagccatctctcctgcctttttctgggctgcccccatcacttcagctgagaagtctgtcagccaagagtgaccagcagagcagtccatgtcagaggcccgaagacctgcccgcatctcacagggctggcagcgtggcctccagcaggtgtctgtccccctggaaaatggccccaaagccccagactgcagagcccggccttggtttgtcaggtctatctctgtgtgtgcctgtccctgcacaagtctcgtctcccccttagaccgcagggtcctggagtacccccttcctgctgattgccaccccctgcataggactccctgaaacaggctttccccagcagcacccccagagcactagggattcgggactgggaacccctattgggggtgcatgggaagcaggggcggctgtcagctcaggagcctgacttagagccaggtccagccctggctggcggccgccaatcccggtgccatctggtgcctatctggcaaaatcaagagatgaatgagcagagagtggcaccaggcctcctgacagactggctcccattgcagggccccgaggtgctaggcaggcctcaggcccctccggccccctcagaattctggctttgctgctgcctctggcactggaggttcagctgtccctggtggggtgcagtggaagggactccagaagttgcatatcctgactatcccgccccctcacacatcccccaagcatggagctggcttctcgattctcaggatggaccccaacacctagaacaagctcttcacattctggtagaggatgatgcccagcctgggacagcggggtccttgcatggaagaggcaacagatacacagggctgtccttccaggccctgcctcagtggcactcagcgcccgaggcctctgggtactctggtcttggacggtatccctctccttgcctttttcccttggccatggagctcaccacccacagccctccctgctagctggggattcctgccttgtctcctgagtggctcggactcttcatcagcagggcctggtccgtatcttcatccagggtctgaaccagaaaccggagaccagctctggcacccctccctcactgaccacgaggcccaccacttggcctcatgccctgtaagctccatcactcccacccaagtgcctcagcgccgggccctctgtttacagagtaggagcttgaaccctaggtggagcttggaaggatggacgagagatgcagctcaggcagtggggcactcagggcccaagggcagggcacttccagagccccgcactgcagggatgaagagtgacaacaggcctctgctctcttccagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctggtgagtgtccctggacgctgggcttggggtgtgtgactcagtctgcaaggggccagggactgtttgaccatgttctgacggagctccagctaccttgatggaaaagcttgtccccagatgaatgttgtccctttttttttttttaccaagcatcaggaatcagatgcctggggtggtgatggggtctccagaaaggtctcccaagtggccccccacaaaccctgccccaatgtgggtttgtcctgtgcccagcagctgtgcaggcagcatttctgcaccgacactgggcatctccagtctctgtccctggcccctgccagctgctgccctgggtctgtgaggtcagaagaaagtttgactccagcacaaatcaattccatcttcttgtgagatcaatagcttttagtgccgttagccagttctttggtttggatgaggaagggagaatttcttttatttatttattttaaagatggggtctcactctgttacccaggctagagtgcagtggtgcgatcacagctcactgcagccacaaactcctaggcttaagcaatcctcccacctcagcctcccaagtggctgggactacaggtgcacaccaccatgcctgcctggctttttttttggggggcggggggtgggcggggaagagacaggctttcatcaagttccccaggctgatctcaaactgctgagctcaagtgatccacctgcctcagcctccaaaagtgctgggattacaggcgtgaggcactacacctgggctgagactatgttgctcaggctggtcttcaacttctggcctcagacattgctcccccctcagcttcccaaagcactgggattacaggcatgagccaccatgctgggccttaaagtgaggatttataactcccgtgcaggagtccatacccagcccaccacactgcctggccactccaccccagctggcgtccacatgcatgctggctgttttcaggagttgttgcgtttttcttgtttttaaatctataatgatttttccaaaagcctctagtgtccacgcagagacgcttctggggtgtggtcaccccagagagtagagtctcccactacctggcagcaggctggcagccaggcaggtcctggtcagcctgggggtgaggatgcctgggctctcatacccaggcagctcaccttgccactgcgagtttcttctctgttggaagatgttcttgatctcgtcctgcctgtagtgggaggctcacctaagccaaaacgcaggcgagacgctaaagcagccttgtggggcggacaaagctctgagcacaaggaaggggaccaaggctgctgcaatacatggccggggctgaaataagagactcagaggacagagttctggacaggccgggaggtcacagtcgagtgcggttcccagtacagtggaagagctttgagaagtgactggtgttaaaaatcctcctgcatggccgggcgcggtgactcatgcctgtaatcccagcactttgggaggccaaggcgggtggatcgcctgagctcaggagttcgagatcaccttgggcaatgtagtgagacctcacctctacaaaaatgagccaggcatggtagtgcatgcttgtagtcctgactgaggcaggaggatgatgagcccaggaggcagaggctacagtgagccatgatcgctccatcgcactctagcctgggtgatgtgagaccctgtctcttacacacacacacacacacagatacacacatacatgcacacacacagatacccacacgacaaacttgttttggaagaatactttggaacagtaagaatggcatgaggagtcaattcttctaatatggaagaattatctgcagtgtagggaaaactcaaggtggaaggaatgtgcgtggcagaatccatcccacaacattctgggcgtgacttgtaccaggcaagagggcaccagcagtaagaaaacaggcaccaagtctgctttcatgatctgtcagcagaggctgagaactgtgtaccagtttgctttgaatcattgcaactaaagagagagggctgggcgtggtggctcacgcctataatcccagcactttgggaggccaaggtgggtggatcacttgaggtcaggagttcgacaccagcctgaccaacatggtgaaaccctgtctctactaaaaatacaaaattagctgggcgtggtggcgagtgcctgtaacctcagctacttgggaggctgaggcaggagtatcatttgaacccgggaggcaggggttgcagtgagccgagattgcgccattgcattctagcctgggctacagagtcagactccgtctcaaaaaaaaaaaaaacaaccaaaaaactaaggagagagctctgaaggaaaggagcaggcatagaagtggatggcccacctgagtccaggcgttcctgggtgacatgggcacccaaacccataggatgagaaggcgttaacttggcaaaggtgggggcaggggaggcggagacacctccaggcagagggaagaggaacgtgcaaaggcccagaggcaggagcgagcatggggctaaaggaagccaatgtggccagagcagagggagcagatgagggggttgggggcactgtcgagggtcggggtgagcaatgagtggcagtgggatggggaaagtgtcacggggtcagaagacacagggggcagatgggattcaaaccatgaagcaactcataggctttgtgaggggtcggggtctttattctaagagccaggggagccactgcaggggctctgcaaagaggtagcgtgacccgataactcaagttgaatgtaacccaggccggcgggagtattcggaacagtgggacttgaatgtgaagaagtggccaccgggtgaccgaagagctcagaggcctaatgagggcagtgagcgaccttgggattagcaatagcaggagccaccaccacctgcaggccagagggacacagggagaggctatgtcaccagggaagctggagccacacagcctgcctatcagcggctgcagaacgaggggagcagggccctggctgccttaccaccacctccagtctcctaccagcacctccatcggcagaagccagctggcaggggagcccgagacattccgtgtgagggatcaacccctgtaatggagaacagggcaggggacagaggagggacaggtccaggcagagggtcgcatagatgcgggcaagagtaaaatcaggccatcagggaggcccagctggagagcagcgggcttacacctgggcgtgggcagtgaccagaggggagtgcccagaggaagagtcagctagggaggtttggggaggagctgctgaagttcatctgcaggtttctggcttaagcccccggatggggtggcagtgctatcctccaaggcaagggacattggcagggaaccgggaagagaagcagacagtcagtttggttgtacacagattgagtttaaggtgcctttgaaccatccaagtgcagttggagttataaagccagggtcatgagggtggccagtgtggaagtcacacacatgggtgacctgccataggaagcacagagtgagaagagaagggggctggggccaagcctggaggaagcacagtgtttaacagctaggacgcaaaaggtgcctgtgaaggagaccaggaaagagtgtcccacaaggaagggctgggaatgccacaagggcacaggagtcactgggcagcgtgttccaggaagaggaaccaagctgaccactgcacgtgggaggggggttgggaaaaacccttgggttaagtgggaggtcattggtcgccttccttggagctgcgtccactgggacacaggaacagccagattggtgtgagttatgggaggggcaggaaggagagtcgggacagcagcaggagaagggatggaggtaaaggttggggcactgaggtgggaggacacatgagctctgctgatgtgattccacctgaaagcgggggattgaatccgcagaagaaaagaccaacaaggggttcctgaaaaagcaaaagggataggaggatatacctctttgttctcctctattatgggggaagggtagtgattttatatttgggaaagagtagtgtgaacacaccagggggaaagcaacaccaccaactcgcttattctccctcaagcagaacagtttttcctatggcccaggtgggatcaatgaccccaggagagaccaggagaacctcattaaacagccaaggcgatttttctttctttcctttcttttctcttcctttcctttcctttttcctttcctttcctttttgacagagtctcactctgtcgcccaggctggagtgcagtggcacgatctcagctcactgcaacctctgcctcccaggttcaagagattctcctgcctcagcctcctgagtagctgggattacaggcactcgccaccatgccccgctaatttttttatttttagtagagatggggttttgccatgttggccaggctggtctcaaactcttgacctcaggtgatctgcctgcctcagcctcccaaagtgctgggattacaggcttgagccccaaggcgatttctgatccccaaagatgaggtgtaatttcacagcccctcctggcccatcgctgataaacccacagggcccgagagaatagaaggatgggaaaatgctggcttcatattgaatccctggaaaacactaaatcgtgactcagagagctagaaaaggatgaacacaaggagtcgacaaaagggcttctcagagcacaatacaattggttcattttcttttaaataaagttacaaattggagggtcacgggaagacaattcatttaatgtataaatatctcagctgagcacttggtgaagctcctcccctctgtgtggatacagttgcattttctatgatggtgcatttaactgggttcaaagctagttacacaactctggttgaacccaatgaatattgacttatgcagtggatttctaaactgtagagggggtgtgtgtaagagagagacagagatacgtaaagcatgcaggaaccttgtttttttttttgttttttttttaatgtctcctgcccccccatcttggatgatacaggaacctcattttaaaaggcacattcccagaccacactgatggaatgggccgggctgcttatctgcacttaacaggctccccaggtgattctgttcccgtggtctgaggaccacatcctgaaaaacactaaattaggagttgagggcgccctggaaggaggtttcttttcttttctttcttttttttttttttttttgagatagagtcttgctctgtctcccaggctggagtgaaatggtgcaatcgttgctccctgcaacctcctcctcctgggttctagcgattctcctgcctcagtctcccgagtagctgggattacaggcatgcgccaccacgcccagctaatttttgcatttttagtagagatggggtttcgccatgttggccaggctggtcttgaactcctgacctcagatgatctgcctgcctcagcctcccaaagtgctaggattacaggcatgagccactgcgcctggtaggaggtttctatcacagtcctccagggggttccgtcctagatcctgtgttgtttaaagaacaacagaacaaatataagtgtggacgtgtacattcatctccccccaccccaacccaaatgagcattttggatgaaaactcaggaggctgcttaatcaatcttcagatggtctcaagtggtgcaggtcagatggaatatgatggatgacaagagtcaagatttgaaatgatttgttcatgctggaatgttggactaaaaccaactagatgagatttcacagggatagatttaaagttctgcttttggttaaaacaacacaaaaatcaatacagcactataggaaggaggagagactgggcttaacagcaattcttgggaagaaattcaggggctgtttgtagaccacaagatcagtggggggcggggggaaccagggcgggtgcaagttcaggtcagtgccctgggaagtggaggacctaaggcatgacccctgctgcgctcagagctgatgaacaacctggacttgagtgactcactcaggccacatttaagagtgacattaaccaattagactttcatttggaggacagtgatggcatgggcaagggtctgaaaccttagtcccaagaaggacacctgcccacttggagagcatgaggtgagagggttatgaggaagccaggttcagctgtctgatggggcacggtgcagaactggaaacttcttccaggctgccctagaagacaaatgaagatccagggggtgagtggtttaaggaggcaggtgtcagctcagtagaagaaggaacattctataagttgggagttcacagtggaagaacagactgtgacatgggtggcctgaggatgttgggggaaagggtggaggatgtcgagagagtccacaattcctggaggtgtcaagagagacccaaggttggcaatgagtatgtgatctcagtagacctcagcgattcccaggcccacctgtgtcagaatcccctgggggctggtaaaagtgcaggtaacctaggccctccccagatctactgcatcagcatcccttgggctggctacagtctcccaacttttggagtcttaggactagaggacagtattttcctattgcccaaataaaatgtcctgtagaaccagcctgccagggaccctgaaccttcacctccccacccccagccccacctgccagaatgtgagatgtcatccacctactcaccgcagcccccaggaaagagttcctcagctcaagtcaaaaacctgctctccatagatgttcacagcagctgtattcagaattgccagaacttggaagcaacgaagatgtctttaacaggtgaatggataagctgtggtccatccagacaatgaaatattattcagcactgaaaaaaatgagttttcaagctggaataagtcatggaagaatcttaaatccatattactaagcgaaagaagccagtccgaaaatgctccacactgtatcgtttcaactctatgacattctgaaaaaggcaaaactaaggagaaagtgaaaaggtcaagggttaaggccaggtgcagtggctcacgcctgtaatcccagcactttgggaggccaaggcaggtggatcacctgaggtcaggagttcaagaccagcctggccaacatggtgaaacctcctttctactaataatacaaaaattagccaggcgtggtggcggacacctgtaatctcagctactcaggaggctgaggcaggagaatcacttaaacccaggagtcgggggttacagtgagctgagatagcgccattgcactccagcctgggcaacagagcgaaactctgtctcaaaaaaataaaaataaaaataaaggggttagaggggagggggtacttaatgggcagagcacagaggaattttagggcagtgaaactaccctgtatgatatggtaatggtggacacgtcattttttcatttttttttttaatttttgcagagatagggtctcactacgttgcgcaggctggtctccaactcctgggctcaagcgacctatccgcctcagcctcccaaagtgttgggatcacaggcgtgagccaccacacccagccaacacatgtcattatccatatgtccaaacctatagaatgtgcaacgctgagaatgaaccctagtggaagctgtgggctctgggtgatgatgtgtgcatctgggctcatcagttgtaatggatgtaccactctggtgcagggttttagggtggagtaagaggctgtgcgtgtgtggggcagcagatatatgggaactctctactgtccacttaattttgctgtgaacctaaaactgctctaaaaacaagcttttttttttttttggagacagagtctagctctgtcacccaggagggagtgcagtgccatgatcttggctcactgcaacctccacctcctgggttcaagcaattctatgcctcaactcaacctcctgagtagctgggattacaggcatgagccaccgcacccaaccctaagcttattttttaatataagcaaacattctcctctgtgtatcacctctaacctctgtttgggatcttgcttatagtgctgcggtgggcgttggtttctatggaaacagcgagaccaacgatggggcgtaccagctgatgtactccttggacgatgccaaccacaccttctctgggatcgatgctctggtaaggctcccgggcagctggccgggtacaggcacagcccacaaggtcagcgtggtcagagcaagggcccccgtcagatcccagctagctcagctgcacacggaggggctgtgtgacgcctgagggctggacccccgcctgcgctgcagttgcctctgctggggcaaatgggcaattgtgcgttccaagcctgcaggggtggcagggatgggggtgaggactaaaggaggcagctgtgggatcaaaccccattttccaacaagccgaacactttctgatttgtcaaaggagaccttgaacatggaaaatcagccccactgcattttttgttttcattttaagtgctgcatatggagtattgcaaggtccaggagatgccaagaggaaaaaactctcttcagagacaactgagggctgggcgtggtggctcactcctgtcttcccagcactttgagggaggccaaggcatgtggagctcaggagtttgagaccagcctgggcaacatggcaaaaccctgtctgtaccaaaaatacaaaaattagccagttgtggtgtggttccagctacttgggaggctgaggcagggagatcacttgagcctgggaagcggaggttgcagtgagccaagatcacgccaccacactccagcctgggcaacagaatgagactccatctcaaaaattaaagaaaaaaaaaaaattgaagagccccgtgatgtaaggtagtggagacctgccccagctcctcggagctctggcttccaggcagtgactccaggtgggggctcacagtgaaggatgctctggcctggccagaggaggtgtcagactcttaggggaaggggaaggctactctgccaagccagggctggattttgtggcagacgctgcctgatacacacgagccttttgctggggctgccacccctctgctggggacctggcccagggaggagcacgacaagggtggacatctgaggacttggttccctgaaaactgcctctgccttttctaccccagctgcctggaattggagttttcccacagtttgaccttggcccccacacacgtcattctcactctaagcaccagaccttttcagctgcttatccgagcagcctctgccacaaaatccagccccaacaggagaatttggccattgccccggcatcctccagaagaggattggaccccatttgcccccctcctgctcccttaagctcctctaaggctttaatccctcagtcaacaaggggggtcgggggtgtcaccttaaagagacagctgtgctgctcctccgtgcccaagtcaattgtgggaggaggccctggcctccagaaaggggctgagggtggctacaaaaccaggggccctggtcctttgcagagttcattccaccgcccgtgtccactgggacccatccccttagctgagcgctgagtcccagtgcggagatgctagtctggaacagccttgcgcggtgagctggggcggctgggttggaggagctgagggacagccagctcaggcctgggaggcagaggtgtggcctgcctggggagaactctccctctgggcacccacccttgccccaggccctggtggggaagggccccatggtcactgccctctaggctctctctgcccctccctgccatcctgctgcctgcctcctcttcacccaccagcaccaggatcactggaggaggaacctagccccgagaggaaaatcccctgccctgcccaggaaggcaccagggccatgaccttcacgggtttagagaaactcccagaactcccttatgggaaaacatcaagtcctagaagtccctatcccacaggacgagagctgccagggaggggagctggaacgggcccccaggctggggcctcccaccccatggcctgatggtgctccagggccaggtttggacatttcacagcaggttccactctctgaaatccctgctccagggccaggtttggacatttcacagcaggccccactctctgaaatcccctgtgttcccaaagagaagggttctgtatccctggagatcagcccctcgtcctctccgttgttaccgagaagtgaggtcaggagtcccagggcttcacactggtccagccagcccatagctgcctccagcctgtgggtggtcacctccccctctggcgtgaacccctagggcccaggtgtagctgctgccttgcctccaggtggaaaggtggcactgggtccttactaggacctgtgaggctggtttgggcctcagagtggacacccagcacaccagtcctcagggctccaggggaggcagcagatcttagaagacttcccagatccaaggggagaagtccggatatcagataaatgactagtgagataatgtcagtgaaagtgctggtagactgtaaagtacactcagctgtatgactgtgattatgagtgctattaattactgtaatcaccttggggtcagcgggaggctgggatccaggacgctgtgggcggcagaggcagatgggggactcgtcgacaggtcaggcaggacctggatctgggccttgccagaggccagatcatgcagctgagtggccaacaagaagccctctagggatgcacccacagagtggggtgggccctgctccaagtcctcctttcctggactggaagccccatacctatgcacgtccaactagagggacacctgtgccttggtgggtaggggcggtggttcagggatcaggcggtcctgggagggctgcacgccccagtctaggggagtagagaggagtcgttttgggataccaaaacttcctgtacctggtagccagcacggcccctccaggctctctcatgtgagtctgcagcaggctgatgggcagccctcagatgtagaaactgaggcacagggaggttgcattgctgacccgaggttgaaaatgtgtatgtttcagagcagaaaccagaacccaggcctcctggtcttagccccttacctccactgacctggcccatccacacttccagataagctcactgagcgctggagagtcctccctcccagaagttttcatacttgagcttgcatcagaatcacctggaagggttggtaaacactgattgcagggccctgcccccagaggttccgcttcagcggtcctggggcagggctgagagcttttgcttttgtgagtgagttcccagggggtgcatcttacgcccctagtcccgggaccacacttgagaactgctctttcctctagaccgtggtctccgccacctgtagctcgtccctaagtctgcccagcctggaaaactgacctgtccctcctgttctcagagctttccgtgagagagagcctgattccatctctgggtcatcccacctgtccctgcggggagtattatgtcctgaaactttaaggaattggggatggtatagagaagtggggagttgtaagtaggtcactgctgtcattcttattttttaaaattttaggatcttttgagcctaggagttcaagaacagcctgggcagcatagcgagaccccatctcaaaaaaacaattttttagttttgtttcctgtgggaaaatatcaggaagaaagagaaggcatgacaaatacaaatactgccttctttttttttccccctaaggaggagtttaagaaatagagaagttaactgtgagagagtagaactgtgagggagaaaacaagtggcctcacagaaaaagtttacagataattttttaacagccctttactctgaagtttgtttgatttatagaaatatagaaatatagaaatgtcacctattactgggtttgttcagaatggcactattctttgatgatagtgccatttgtataaatgtttccaaagtggttgtacatttatcttattaaattgaacagccaagtgtactagcatgacatttagttactgaatgtacttttacatggtttggggtcttttcccctgtgcttcgggctgtcgaatctgcacatggtagagtgtctccgtactctggtatctcttagtccttaaccaactcgtaagaaccaagcataagccagaaaacggaacaagccgctgacactgaaaaaataaaacaaaatgaaacaaagagagccattctcttttctggaactaggaactcccagcgtagcgcagatgtaaaaggccacacagctgatgtgaagtccccataacacagagaacaccgttggcctccgagagtggaatctaatcggccttgctgatctcactgtgggaagtttctgcctcttcttctgtgtcgtttttatctcccagacccgtgggagctgaaggctgccgagtgtggattagtgcacactgccccactcccggcccgttgtgcttcttggtttagtgtgacagtttcagaacaacaaagccctttctccgctcgctgccagcaagggcgtgcttggggctgccaagctgcaccccggggttctgcaggcaccctgggtctgggctgtgggaaagtcccgctaaccagtacgagccctgcctgtgctcttcaaaagccagctagggttgaccacttggaccattagaaatggatgcacatggccgggcgtggtggctcatgcttgcaatcccagcattttgggaggccgaggtgggtggatcacttgaggccaggagctcgagagaccagcctggccaacatggtgaaactgtctccactaaaaatacaaaaattagccgggcatggtggtgcacacctgtagtcctagctacttgggagggaggctgaggcaggagaatcacttgaacccgggaggcggaggttgcagtgagccaagattgcaccactgcactccagcctgggtgacacagagcgagactccatctcaaaaaaaaaaaaaaaacaaaaaagagaaagaaagaaatggatgaacgggctactctggcacactgcctagagggtagccctgctctgcaaggagcagtacctttaaatataaataaataaataatgtttttaactggatggccagccgtcaactttctatttctgtcttgcattggcagatgtttccttcagggtccactcaaccccaggcccttagggctcagccaagggacaggagcctgtctgcccacccagcaggacacacatccaggggaggatgtgaatacaaggagaaggcgccggtttcctcctcctgcctcatgtccaggctcctcagagacaggatcgcagctgtttttgtttttgcaaagtcccattgtcctgccttcactcagcgttcaggacccggtgtgctgcggctagtgccacaacaaagcttttctcttatagaacaattagaaatcctattgtggggatacaaggtcaaggtagcaacatagagtctgtttctctaaaagagaatttgtaagccaaagtgctgaaagttttaagagaatcttcaaagaataatggattattttgttggtttctccatctgggtgtctctgtatatagtaaggtatagtaatgaatgcatacgtttattccagccctttacagcaggggccacgtggtgggcacacaggatagcctccttagtagagagcaacagaggctccagagggcagggatgtgcccacactcccagcgccagaggctagacctggcctcagcctgcaacacataatggtgtgctcctttggcgccagcattctctctctcggagcccagatcctgtttaaggccaggtcagggactgccccctggtttgagggacatgaggactgggtgggtagtggcggcctctgtcttcagtccttcctccaggggcacaggctcgagatcttcaggcctggggcagcatggtgtgttcattcatgcctaagcaggccaggccagctttttttttttttttttcgacacagagtatcactcttgtcgcccaggctggagtgcaatggtgcgatcttgactcattgcagactccgcctcccgggtccaagtgattgtcctgcctcaacctcccaagtagctaggactataggtacatgccaccacacctggctaatttttatatatttttttgtagagacagggtctcactgtgttgcccaggctggtctcaaactcctgggttcaagcaatccgcctgcctcagcctcccgaagtgctgggatgacaggcatgagcgtaattatcgcacctggccaggccaccttctgctgcctgcaaagacctcttccgggatgagaatcagaagctctacctccatggcttttgccccctgctcctccctaggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtgaaggaccggtgggaggcagagggaggggcagcagcggctacatcagctttgtttatccaaacctgcatgttgagctccaggtggagaagggccactggaaagtattttttttttgttttgtttttttaagacagagtcttgctctgttgcccaggctggagtgaagtggcacgatctcagctcactacaatctctacctccggggttcaagagattctcttgcctcagcctccctcccaagtagctgggactacaggtgtgtgccgccacgccagactaatttttgtatttttagtagagacagagtttcaccatgttggccaggctagtctctcgagctcctggcctcaagtgatccactggcctcagcctcccaaagtgctgggattacaggcgtgagccaccatgcccagcccaccagaaagtcttgataagccattggccaaaatcaggagaacatgggggcttacaggggccacgtggtgagcatgcaggatagcctccttaatagataggcagcagaggctacagaggacagggatgtgctcacactccccgcgccaaaggctggacctggcctcagcctcccgcacacggtggggtgcttctctgggactagcattcttcgtggctggtgcagggtggaaacgccacatgcttcataggttcctcgcctgccagagttcatgggacaggatttcttgtatccacagacacagccacagggttatggggggttgaggagatgagcacccggctaagggtgctaagaagttgccatcaggggaggctctgacctacaagtcattgtgctcccagggcctgggcctaagcgtggaggaggcacaagggaggaatgaggctgtgtccccagactcactttttttttctttctttttaagacagtatctcactctgtcacccaggctggagtgcagtggtgtgatcatggctcattgtagccttgaactcctgggctcaagtgatcctcccgcctcagcctcctgagtagctgggactacaggcatacaaccacacctggctagtttaaaaaaatttttttttgcagctgggactggtggctcacacctataatcccagcactttgggaggccaaggcaggcagatcgcctgaggtcgggagtccgagaccagcctgaccaacatggagaaaccctgtctctactaaaaaatacaaaattagctgggcgtggtggcgcatgcctgtaatcccagctacttgggaggctgaggcagcagaattgcttgaacccaggaggtggaggttgcagtgagccaagatcatgccatcacactccagcctcagcaacaagagggaaactccatctcaaaaaaaaaaaaaaaatttttttttagaaataggggtcttgctttgttgcccaggctggtctcaaactcctggcctcaagcaatcctcccacctcagcctcccaaagtccaaggattacagacatgagccaccatgcccagaccagcctcacttatgtagaacctgagtgatggggactgaggggcaccaccctcacttaggtgtacaaactcatgcccgtgtcatctgacctctggggctttgtttacatctcccctgcctccccatttgccaaatcccagcctagccagaggcactggacacaatcggcggagcagggacctgctgcccctctccaggtgcagggtccagcgaagtttgctccgtggaaagcacaggaaggaggcagcagccccagcctttggagggctcccggctgaatgatggcctgggcttgtgctcccagggcccgggcctagcatggaggaggcacgtggggaggggaagcatgagtcaggaggagcgagtgtcagttctttggatccctccccgcaccctccatttgttggctcctcttcaagccattgatgaacgtcagagcctttagctcagggttgcacaacttacttctgttttctggatttgtgtccccttgtgtcataaagccccactccaggaggtcactgctggactgagtccaggggcctctccccttcccaaaaataggaggtggcaggtccctgagcagagggagctcatgaagtccccagctctgggggtcctccccacaccttgcctccccagcccgtccagtccctgcatctccgccatgtcctggatgctctggattgaagggaccttggccccactccccagcagatggatgctcatgggcaaaagagcctccctcccaagggacagaaggaaactgccagctctaaggactgtctgtgacctcctgtggccccaaaacaggggtgtctgatgattctcctgatgcatgggccattcattgcctgagccttcgaaatcttatgtcaggcaggggcaggacccattttaacgtcactcttctctgagcacacctagcagaggactgtgtatgtttaagggcctcatgtgggcattttgttaatgacactgatggaattaagtcagaatttacatatcaaaggcggcttattgttaaggcgatggtattaaaatagtggaaggatggtgtcaactgcacatcagctatttcagcgtgggtgattgacaggaccccctgtgagtccatccccaactccccactgcttattcgggttgaggcagaagaggtttggctcatgctgtaatcccagcactttgggaggctgaggtgggtggatcacctgaggccagtaattcgagaccagcctgggcaacatggagaaacctcatctctactaaaaatacaaaaattagctggacgtggtggcgcacgcctgtagtcccagctacttgggaggctgaggcaggaaaattgcttgaacccaggaagcggaggctgcagtgagccgagattgcgccactgcactccagtcagggcaatagagtgagactctgtctcaaaaaaaaaaaaaaagcagaggtctagtccaaggttggcacctatggcgcctgaacatcagtgatattctaccccttctcctgtctttgcttccatctgtggcttctcctctcacctgagctgctctgcaaaaaaagccctcccctgaagggcccctgtctttgcttttgggatagtccttgagcataaccatgcagcaaagcagatatttcctagcatttttatacaaggcggggcgaagtattggaggagataaaaagccaaggggctcctctctttgagaggctacggttgagggaagagggagccggggtgggagtggctctggcaggcagagccgagttcttggttaggaatacatcccccagtcctcgcccagctcctctgggaaaacacatccgcctagaggagatgtttccaggaacccctgacaacatgaggcgtggaggcagggaaaatacattgaatcacagccacagagagtgggttagaagcacccctaactggatttcctgctgctctgcagagcggaggcgagtggtgagaagaaatctttaagtttgaaacatgaactgggtatttcgagaggtgccctgtagctggctgtgtcccttgcaggaagcttgatgtagacaatgtggaatttctgggccaggctctccccaccaggggccttggctttctaatctgtactaatctgtagaatgggatccagctcacacctatgatcccagcactttgggaggctgaggcaggaggatctcttgagtccaggagtttgagaccagcctggacaacatagacagacccggtatttataatacgtgtgtgtgtgtgtgtgtgtgtgtgtgtgtgtgtgcgtgtaaaaataagaatgtgatccaaacactagatggtttgcgaggttccttccagctctgagctaagtctaaggaaactggcttcttggtggcagcaggctctgcccactccccaaagcccccggctccattccggggaaccccagagacctagtgtgtgctgccccctgctcgtgcagagacaaggactttgattagtccccttcttttggcagtaagcctcaattcggggagtcagaaagaacctcccttggctgccaggcctccagcttgctccctcccctctctccctcggagcctctttgccactttctgccagctccagggcactccctgcccacgctccaaactccgtcttcccctttatgatgtcagtgaagcagaaaaccattgctggagaggagaggtcagcgactttacttggctcttgcagcaagagaaataatgatccaaatacttccctctttggggacggggaagcccctgtctctgtgcccgcccctcctctgtccactctcccgctggtgcccagcacagggtaaagggcatggctgccaggggagaccactgggccttgtgaggaccaccttggggacctgtgtggaagggaaaggaacgagggcactttgtttggggtcttctcagtgtccgttggcttaagatactttgattcttcagcctgttctctggagaagcaggagggcagggcctttgaagtccttggctgccttgccccatcaacctttatatttagcaagcacttaatccttcctctggccctgtgagatgaggggttccagctccctctacagatatggaaaccaaggtctcaaggggtgaagtggcttaccaaggtctcccagctggggtgtgactgcctttccccatcagtccagccctggggacaaaaaggccagaggaatgaagggcttggaggaggctggaggtctgcagggctgtaggtaccctgacctggactcccgggttccacactgagccctctgatggtcagaaacgagcccactcacctgggtatccctggtgccaagctcagtgcctggcacaaatgttgtttaaaaatgaacctgaagttttttgttgttgttgtttttgagatggagtctcactctgtggcccaggctggagtgcaatggcgccatctcagctcactgcaacctctgcctcctggtttcaagtgattctcctgcatcagcctcccgagtagctgggactacaggtgcccgccaccacacctggctaatttttgtatattttgtagagatgaggtttcaccacgttggccaggctggtctcgaactcctggcctcaagtgatctgcccgtcttggcctcccaaagtgctgggattacaggcgtgagccactgcgcctgtcctgaacctaaaagtcttaagttatggatcccatccagcaagggggcaagatgggaggccttggggagccaggctgagtgtttgtcaaagaggcaggcaccttaggggctgtgttagatctgtggctataaacatcaggccttggctggtctgatgctgtctgagagttctagaagcaaagggaagcagggtcctaggcgatgcctgctgggaggccgcagaaagacacttcagagctgtgctgtccagggtggtagccccagccatgtgtggctattgaaattaattaaaattaagtaaagtttaaaatgtatttcttcagttgcacaagccatatttcaagttctcggtagccacctgtgggtagtggcaaagaagagagtggacagcagggatttagaacagctcctccactggggaaagttctagtgcacagtgctggttttgacactcagcctagaggtgaaggcagggggtgtgaattgacagctttgtccaggcagcagtgggggtgcagctcccgaggcttcagcccacgcatgctgggtgcttgctggctctgggcagcatgtccatagtagagggtccagtgtgtcccagggctgccgtgcaggcctctcacgtggccagcaggtcagaagttccaccctgctgctcctgaccatccctgcccctctacccaggtggctctcctacctcctgctctttatcctggacctggtcatctgcctcattgcctgcctgggactggccaagcgctccaagtgtctcctggcctcgtgagtatccctacccgtggacctgggacaaagagctgggcaggatgccatcatcagagagagacgagggcctggccagctccagagtgtggggaaaatagccaggctgcctgaggccaccttctgccccgtcctcagcactcagcagaggagacagacagcagccaccaactcaccatctggtcaccaaacgagcaagcattaggctttcctccttctctgggcctgactctgttgagcagctaagaaacatgggtccgtgcatgaaagcctctggccgtcttagccaacactgcccccttagcctgtgctctcacgcctgggtctctttagcctcaaggacctgggctccatggtcctttcctagtagtgagcagggcccacgtcagggcagggactgaggctgcctttggatccattgcaagggtctgggggcagggtgggtggggtgatggctgagaggaaggggaccccgcctgccaacgttgtcgcctgcctctctcctaggatgctgtgctgtggggcactgagcctgctcctcagttgggcatccctggccgctgatggctctgcggcagtggtgagttgggggagggagtgggtggtgggtggtggttggtctgccaggacactctggtgtgtctccaagcagggccagcttccggtcccagctcctaacctagaatcccagaatctcagaaccaaagggacttgcgtcatctgaaccggcccctctcgttacagatggggaaacaggcccagagaaaggaaggggactgcccagggtcagagccaggataagacactcatgcttcatacccagagagaagcccccggctgcccaggcatgcttaggcttacacgtgcttaggcttaggcgtgcctgggtgaccagggcgcttctctctgggtgtgaagaactgaccgggtctcctgagaatgggtaggggtccaagcctcagactggggaatccctcccgcatcagaagctgctgctttgccagctccccaggccctgggactgtagaatgtggtgtctgacttgccttccatcccaatgtcccaggactcccgcggtctgaagcacacatgctgtatgtttctggatgtgatgtctcaaaatggcttaaaaaaaaaaagttgggggcttcctatgcgggtccacatgatctttaaaggacctaacactggcgctaagctgtgtgcatgaggctgttcattcactcagctgacattgtttgctgggtggcactcgatggtacaagttgcctggggttgcggaagccaagaggacgtgatgtttgctgttgacaaagttccagcctttggaagcaagactcataggcagatcactgcaaccccaggctttgatacagtggaggtgcagtgtgtgtgtgtgtgtgtgtgtgtgtgtttgtgtgtgtgtgttcatgcacatgcacgtgatagaagagaacacagtttaccaggggaattcaaggaacccctcactgattcaaagtccacagactaaccctgggacatgcatctgttctgccatagtgacctgaggcttgataggataagatgggggtggcttgtacaagaagctccctaaccacactcacacctcgtccagtgacttgggggctggccactagctctgggcgtggacacaatgccctcagggactctggcactgcctgacttagcaccttaggcagaggcttgtgcagaagggagaagagggggcattttctgtctttgcctcctgccaccccagtgcagtgaccacggaccaaggaatggtcgagaaaaggcccaagtcatgtttgaaagcatgcaggagctgggacggctgtaaacagtgccactgctggccagggtgatgcaggcagctgcctggcctccagcctctcctctggggccagggccacgcacagggaagctgcagggagcacacggcgaactcctccagggccccatcccgctttctgggcagcctctgccttctggaggcagcggtggcttccagcttgccgctgtgagctgccctgtggtggccgcccctcccagtgggggctcctccctctcaccaggcttcagtgttcacgaaaaccagaggccatttaatctcccagctgggcgccctggaatgcggggagctggggagaaaggccatttccctaattcctctagtcaggcccctgagtgcgagatggggagcaggcggtggagctgaatgggcttttgacgggctggagatgctgctgcattttaataggaagccgggtgaggaggagccaggagggcggggagggcggccggctgtcccggggttgttgtggagagcttttgtgtggcctcccaatgccaccctgctctctgaggcctgttttgacagccatggggccagaggattgacaaggcctcccttccccacccccgacccctacccctccctgtccctagaaaggactccatgaggacagagcactgccctggagatctgctctgggtgaggcagggagaggagggagcagcggagctccaagcttccaggccctggggccacccctcgtggtcagcactgcgagtcaggaggtgtctggggtgaggggctagagcaggcagagaggctgggaagccctggaagaaggaaggggaaggaaatgggttcagctgtgagggaggaggcaatggctgtcacaagtgctttggccaccgagcctggggacagagaacttcaggggattcctccagctaaggggcagccaggcctgcccctgagtcagagggtgggagtgtggcctctgcagccaccctgtctgggcccacatcctcccttcaccccttcccagcagtggaaacccaggaaagttcctgaggttttctgtgcctcagcttcctcctaggtgaacacagagaataacaggacttacctcaaagggctgttgctagggaaagatgagtgggttcatcctgggaggcacacagaaaatgtccaataaacagtggccaccactggcttcctgtgcattcatcgtcatcatgctagggtcacgggggtcccttcagacccacacctccattctcaggagctgcctgcaggctcagccatcacctgggctggttactgggcagcctctcccacctgccccaactatgctcagtgacctccttcctgtcccctctcctgccatccctatcaccatggcatgagtaatgcacacgtgtattagtccattttcacactgctgataaagacatacccaagactgggcaatttacaaaagaaagaggtttgattggactcacagttccacatggctgaggaagccccacaatcatggtggaaggcaaggaggagcaagtcacgtcttacatggatggcagcaggcaaagagagaggacgtatgcagggaaactcctgtttttaaaaccatcagatctgccaggtgtggtggctcacacctgtaatcccagcactttgggaggctgaggcagggggatcacctgaggtcaggagttcaaaaccagcctgaccaacatgccagaaccccatctctagtaaaaatacaaaattagccaggcatagtggtgcattcctataatctcagctactcgggagactgaggcaggaggattgcttgaacccgggaggtggacgttgcagtgagccaagatcacgccactgcactccagcctgggcgacagagtgagactctgtctcaaaaaaaaaaaaaaaaaaaaatcaggtcttgtgagacttattcattatcaaaagaacagcgtgagaaagacttgcccccgtgactcagttacctcccaccaggtccctcccataacatgtgggaattcaagatgagatctgggtggaccatttcgacatgcacacacacaagggcatcacacacatacatgcacacgcacacaggtgcttgtcttcattaataggagagttgactcctcactgagtcccacaccccaaaccatcctatgcacctatcccaggagatggaggctccagggtggccaaggggtgtgaagagcaggcctggcctgggaggggaaggaggagagaggcaggaggaagaccatgtcactgtggagccttggactggagcctcctgtccctctcctttcttggttcccaaacttcttgggggtgacccaaactgagatggtggcctcgctctttatttccccaaggcttccccatcctccacttgggcctggctgcactctctgtcactccagccagggggtgggggcacaccaccaggcctgctggcgccgcagctctgataggtaataataggccaggttgatgtattatgaatgctggtggtttgtgtataaagcatttctcccagggtcttaagtgcgtgcgtgcgtgcgtgcatgcgtgtgtgtgtgtgtgcgcgtgcgtgcatgtggggctctcgggaagctctgtatctggaggggtgtgttattccgcaccctcgctatacacacattttctagaccgtaagtgctgtgatgcactaacctctaggtgctagaaccctgcacggcactgagtaagtactccataaatgtctatcaacttagcaagttagtgagtgatgctctattgtggacccctgaggcagtggctcctgaaggaggacggggccaccggcagagcagggcactcagaggggtcccctgcccggggagcatgtgccagaggagggggacatccctaaggaacaggccagaggacctgagctctccctggctgctctggaaggcggaggccccccagtttatccagtccctagagcaccccaggccagatctggggtgcgcctggcttggaggccatgtccttgctgccgcctctcctggggcctgcgtctgctcccaccctgccgcatgggccttagcaatcacttagccaggccgtgctgtggggccaggtcctccagctcataagtggcagccgcctctcagctccatgcccttcccaccccatgtcttggcaggtgagcacctgcacccaaggctcacagatgcttcagcaccaacctcattctttagaaagagtttgggggaggcttcatagattgaacacccgtccctgtagcacttgatcatagcaagacaaaatgtaaaacagcagatgaggccatggtgtaacgaactcccacacacacagcctgcagctgccctggggcccaggatgctggcccccaaaggtctgtcccagaagaggcattcgggaataagagtaacagcatgcgctctgccccagtcacttttctgagcactttacttgcattgggtgaatagcattatcatctccatgtcacagatgaggcaaccggggcacaggaagaataagtaacttgtccaaggcaacagagctaggaaggggcagagccaggtttgaacccaggaggctggctccagactgtcctttgccacctgggagggagctcaaggggctggggtgatgggctcccggctcctcccagggccccgctgtcctgatacctgattttcctccaccccgtccctctctccctcactcaggccaccagtgacttctgtgtggctcctgacaccttcatcctgaacgtcacggagggccagatcagcacaggtaactacacactctcaggctgctgctgtggatgcataggtggccggactctgtgcccctacttacctctttcagccctgtagccatccaacccctcctcaaccctgaacttcaagtccagctcatgctctaggccatttcctagaaagtgcctcccttgggagctcagggacggggagggaggtctggcttggccaccaaggatgatagagatctcatctggtcatttgtgagctgcctaacgttatgccgttgccctgcagaggtgactcgctactacctgtattgcagccagagtggaagcagccccttccagcaggtatggccccccgaggcctgccctcaccctgcccacagccgctcccccttgaccctaagcctcaccactgaccaagatggcggaggtggcagggccttgcttgcctcactgtggtcctctccttagctgcttctgtgaggggggcgtgcttttggtcgtgggttctagattggtggttaacacatatgcagctcaatgcgggagctagttcccatgcagatgctgtccaggagctctggggtggggccgagattctgtactactcacaagctcccaggtgaggccagggctgctggtccaaagaccacatctgagctgcaagcagggagaagactgtgcagctctcaagaagccagaggagtagggggagacttcctgcaagtggaggggcctgtgcagctgcagccaggtgggggggtgggaggggcaggagcataggcccctcagccactgtggggctcctgggagacggagcctcactgtggggctcctgggagacggagcctcactgtggggctgtgtctttcctggctcagaccctgaccaccttccagcgcgcacttaccaccatgcagatccaggtcgcggggctgctgcagtttgccgtgcccctcttctccactgcagaggtaaggcagctgtgcaggaagaggggagccccagatgaaccctgacagccctttcccctgccccggccccagggccaggctgtgcacagcttgctgctggctctctgttctcccgcccccgtgactcggctccctcccttggctctagaggcccctgagcacagctgctgtggtggttttctccgccagctctcctccacagcccctcggcctctctcgctctcttcccgcttcaggaagacctgcttgcaatccagctcctgctgaactcctcagagtccagccttcaccagctgaccgccatggtggactgccgagggctgcacaaggtgcatggggaccctggggtcacgtggagagtgtgagggcacccagcaggccacaccttccagagaaaagccggtagaggccgaggggagcgatggcctgggtccccttccggcccaggaatggaactgaagccagataatgggaagggagggggtgcctggcttctccaggggctgagacagggagactcagtacaagggaccaggggttcgggatgggagggttggatgcggttggctctgggtcactgggggaccctgaacaatgcaagggaggctgttccccattgtccagactcctagccatttcctcaacacatctgtctccctgggttgcaagtggatgtcccaatcccattgccagagtcttctttccaggaacttggaatatcagacagacacaatgatgcagggaacacatggggagcacgtgagagccccccacccaaaagcagtgagccagtgtatggcgacagctttcacatcccagatggatttagtgcagacagtctttgtcatcatcacagctgtcagctccatgcttggccctgttctgtgcattttatatccagtatgtcattcagttctcacagttatactgtgaaccacacgttatttcctaggaaattgacttgcttgtgcgtgtgtatggatagatccatagatacagctatgtgtgtgtgcacgtgcgtgtgtctgtgtgtgtgtgcgtgtgtgtgcacttgtggtgtatatgtctgtgcgtgtgtggtgtgtttctgcggttgtgtgggtgcacatatgtgatgtgtgtatgtatgtgtgtggtatgtgcatgcttgtgcgcatgtgtgctgtgcatgcgtgtgtgtggtgcatgtgtatgtgcctgtatgtgtgtgtggggtgtgtggtgtgtgcgtgtgtgtggtgtgtgcatgtctgtgatgtgtgtggtgtgtgtgcatgtgtgttgtgtgcacatgtgtgcacatgtatgtggtgtgtgtggtgcatgtgtgtgtgcatgtggggggtgcatgtgtgtggggggtgtgtgtgcgtgtatttataaagtggcttactgaagagtcccgagttggcacatcaggggcttgggtttagatcctggtagtctgacctcagagctaagaacatggcagtcacccctgtctcctctcttcttccccttctacatctaatccccagcaagtcttggcagctctcctctcagctgtaccctgaatccatccatttctctttctctccatggcttccaccacgatccggtcctgcccctccagcagacagtggcctcttcccactttctcttgccccctcaccacccatgagctttcacacatgcaaccagagcagtccttttgcagactaggttggatcacatcccttccactcccacaccctccaatgtctttctgactccttttaaaagtccgtactcctctcccgcattgcaaggcccagcacgacccagcccctgctggcctatgttctctctctttcctgaacaggccaagcctgtcccctttgccccctcttctcaaggtgtgctgcttcttgccatcctggcctcagcttcagtgcccccgtctctggttccccaccctgcaacctcctccgccctgttcagagccagcttcttagtgcccagctcacagtaagtgctcagcaaatgtttccagcgtgaacccaagaagccccattgtgttaggctccagagtgtggacctttaatggtgctgcaaggcgctcgggatggggagcagccaggagaccccaggtccaggctcgggggagagggacttccagaggagagctcggcccgcaggctttgcccccgctccttcactagctgcatgtccctcctcttcctccaggattatctggacgctcttgctggcatctgctacgacggcctccagggcttgctgtaccttggcctcttctccttcctggccgccctcgccttctccaccatgatctgtgcagggccaagggcctggaagcacttcaccaccaggtgggctgcctagtaaggaggggagcctcccacagcctggagttctgggagagcagcagacaggggcctctgctctacgatttagctgataacccaggactgaggagggcagcagagggcccgggcattcagcccaacaggctggctgacttctacagaagcttccccaagagtccacacagaccctccaaaggagttcggtggggcccagagcaagagctggggcccagggtggtgacagccctcaggccacagtctggcctcccttctcctctcttctcaccaggactttgcgatctggaatgaggagagttcttggtgctgggaggggtgccccaggaatagcaagaaggatacatggggtcactgttttcagggagcctgcagtccccttgaggagatgggcagggacacatggtgtacaggcacctggtgagcggattaggcaagaggacgcagggtagtggggacccacatgcgcatggtcagcgtggtggggagcctggaagagctggtcgtgaagctgggaatgggccagaatgatctgcaggaggcaggctggggaccgcgttttagaggagtctcaaggagacacgcgtggccagagagtcctgggaggaaaggcagggaagtaggacaggacctggctgcctcggagcctccttcacccttcacagccggccatcttctacccattgttctagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgtacggcctgcacacacacccaggctgggtagcactgcccggacagcatgttgggtggggtccacagtgccgggtgtggggaggaaggcatccaaggccacccgtggtccccactacagccacagggtgcctggagggaaggcccccggggagcatctagtcacccctccacacccacatgtgctgggggaagaaaccactgatgtcagcagcctctgccacaagctggtgggacaggtctcaggcccaaaaagctgcatttctccaggccatgctgctcccagcctccgttgcccatcagccacttgtccccaggcttcccaaggtgctcttctccatatctgcccactgcaccccctccactctatctgtggtttggttccatcccccacctcccatgtgctcacccatgggaccctcctgtagaaatctacacacacccccactcccacaccatcccctcctgagctctcctctcatccccgcaggaaccaagccatgctctttggtaggaacccacgctacgagaacgtgccactaatcgggagagcctcccctccgcctacggtaattggggctctggcccttccttgttggggtaatacataaagacaaaacctcctgccaacccagtgaatcctgtccacaaaggcagaaaagaatgaaactgttctgttattgaatatgcactaaaccagaccgtcgtgggtatcccaggcagtccgctaaggagattgcaaagatgcaagaaatctcactccttcccctagccaggcaggaacaagacacagcccactgcatacctgtcatccagcaagaggacttgacggcactgtttgtcacagtagtccaccttaatccacttgctaattggggtggccatcctggttaagtaattgcctttatttatttatttatttattttttgaggcagaatctcactctattgcccaggctggggtgcagtggcgcaatatcggcttactgcaacccaggtttcaagcaattatcctgcctcagcctcccaagtaggtgggactacaggtgcgtgccacaacgccaggctaatttttgtatttttagtagagatggggtttctccatgatggccaggctggtctcaaacttctgacctcaggtgatccacccgcctcggcctcccaaagtgctgggattacaggcatgagccaccgcgcccggccagctaattgcctttatccagaggaaaaataaaactcctatttccgtgacaatcagatagctacaacttggagccaggcccctaagtgaactgtcactgagaaggagatgaggtgctgtcttcctgatgtttgtacttccaagagatggctcccagacctgaaaaaaccatacctggattgtaacactggcaagggccatattcagcctttaagaaggtttgcagacatctcaaaagacagaaattatttacaatgataagttttctaaaggaaatactgcaagaagagagggggtctctttccctttttgctccagagaaaattaaggaattttttttctttttagatttctgtttaccttaatccttggtctcttttgggctggacggtgggttggctgtggtggcgggtctgggagggctgaacccaaacacagccttcctcaatccgtctcagctccccatgtccctaggactgtgcccaagtagggccagtgcctcttgtccaccccaccacctccagccagagtacctgagatacagcctcaggggagtagctcagggtgggcaggttgagaaggaaagactatgctgtctcatcccagagaagtatccaaaggacacagaaatactggctgagacaaagaaagctgtaaacagacagtgaagtgaccgccaaggttcagggacacggactccagtgccaaaggcctgggttcaaatcccagctcatggcttatggcctctgtgactttggacaagcactttgctgctctgtgcctcagtttccccatctatagaatgagtatgggaatactagcacattcctcctcggtggtgtgtgcaatgggcaaattgattgttatcagagcgtacgtgcgaagcatccagtgagtgccgtaggacagtgagctgttatttgtgactttcttccaccccaccttctccacagagctgtggcatttatcaattttattttattttttattttttatttttttttgagacggagtctcactcttctgcccaggctggagtgcagtgatgtcatctcagctcactacaacctccacctcccaggttcaagtgattctcctgcctcagcctccctactagctgggattacaggcatgcaccaccacacctggctaatttttgtatttttagcagagacagggctggctggtcttgaactcctgacctcaggtgatccacccatcttggcctcccaaagtgctgggattacaggcatgagccaccgtgcccggccagagctgtggcatttataagaaaggacaaggggaatgaaaggccagaagtctgccatggggtgggcagaagggtcctggagccaggcatctcccttcattgggcctggcgaggcatttcagtgccccgacccagatagtttggaaggggacatccaacaggaaagcagaagcactggggcccaaatacctgggaccagcgtgatagacctgggccctgaggacccaggaagtgcacgcacaggcacccagggagtcagcttcccggtcatggcgcttggtgaaaatcatagtgtcagacccgagaaaagagcaagtggaacccagtccctgtcttcaggaagttccagtctatagaaggggcactcaagaaggctgcctgtagaaagtgctacaaggtactttgggaccagaaagaaggagccatctttgctgctgctctaggggattccagaaggttctatttaataggtggcgtttgagccacagtgtagagcaggggctcacccaggggcagttttcccccctggggacatttggcaatgtctggaggcattttcattaccacgcttggaggctggggatgggggctggatgctattgacatctagggagtggagcacccaccacaaagcacggtgcagccccaaatgcccataggttatggggcctgtcctctgcgtgtgggatgttcagcagcatccctggcctctacctgctagcaagcctgctggaaccaatccccctgtcattcactcctgtgccaccaccttggtgcttttgcctggagcacctcacctgctgtcccatcccacagctttacaaacacaagccccagcctcatgtcgttctttcttcctggggtccccgggagtgggctggttgaacctgtattcaaagtcagcaccatttattatttatgtttatttttttgagacagagtatcactctgtgacctaggctggagtacgtggtgcaatctcagctcactgcatcctccacctcctgagttcaagcaattctcatgcctcagcctcccaagtacttgggactataggcacgtgccatcacacccagctaatctttgcattttcagtagagacggggtttcgccatgcaggccaggctagtctctaactcctggcctcaagtgatgcacctgccttggcctcccaaagtgctggggttacaggcatgagccaccacgcccagcctaaaagtcagcaccttttaaatgccagcctagcttctctcactaatcagaagcctcccgggttcctttttccaaccaccagctgccgtggccccaggaatgcagattgactttaatattaatctaagcacaacgtaattaggggaaatctgctgtgaaaaaagaattactctatgcactgtgatgccaaataaaaatgattttcagattcccttctgtttgaaagatccaggccactcatcctgccgttagcagagataatcagcaactgaccttatttgcaaggctcaaggacagaaaacccttcctccctagatttaagacctgcccagaaacacttattgctttggccaagttgactgcccagtcccacctagcccagcctgccctgggaagacccttccacctccatgcccggtaagggacctagagagacatctaatgatgccgcagaccaaggaaccccacagcatggagggtgtgggtgtctgccccagtaaagacagcacagctggctgcgccccaccctccccggggcgcctgctctaaacactccttagcaccgagcaagttcgagaggtggataaactcctccctctgccgagcaccctctctgggacagtcaggggacctcactgggtgggtgatgtcacgcctggtgatcgggatatacagcctgtcccttgctggaaatgtttcttcccccagctctgccttcaaggaataatctctcctgtccttttaggcactgtttcttggacttgatgaacaaaaatgacccagggcagttaaagatactgacgttgagacttctcttcagacttacagaaacagaatatcttggggaaggagcctgggagattctaagtttaacaaacttattatcattcaagttgggaaatattgctttaagaaggagggtcttggccagcaccatgcctcatgcctgtaatcccagcactttgggaggccaaggcaggtggatcacttgaggccaggagctcgagaccagcctggtcaacatggtgaaaccccgtctctactaaaaatacaaaaattagctgggcatggtgatgggtgcctgtaatcccacctactcgggaggctgaggcaggagaatcacttgaacccaggaggcggaggttgtagtgagctgagattgcaccactgcactccagcctgggtgacagagtgagattctgtctcaaagaaaataaaaaagaagaaggagggtctcatacttgcgtatgcatcagaatcgcctgagggacccaccctgtttctgattcagaaaatctgagttggagcctggagatgtgccttttttgtttttttgagactgagtttcactcttgttgcccaggctggagtgcagtggcataatctcggctcactgcaacctccgctccccaggaccaagcgattctcctgcctcagcctcctgagtagctgagattacaggcccccaccaccacgcccagctgactttttgtatttttagtagagacagggtttcaccatgttggccaggctggtcttgaactcctgagctctggtgatccacctgtctcggcttcccaaagtgctgggattacaggtgtgagccaccgtgcctggccggagatgtgcgtgtctgacatattcctaggtaaagctgctgctgctgccctggaaaccacgcttggagaaccactgctctgaggccagcttcttcagcctcagtgctattgatgggcagcgtcattctcggtggggggttcctgtacattgtaggacgtctagcagcatccctggcatctacttgctacatgccagtggcagcccagtgcccagttgtgacaaccagaatatctccagacattgcctaatgcccctgggaggtaaaaacatccctggttgagacccactgggtcgaaaacctcatgctccctcctccccaaccccagcccaagtggaagcattccattccccctgatgtgaatggcctggacccctgaagcttcccgggtcaggagagtggcagtttctggaagcttgttagaagtgcagaatctcaggtcctgtggacaagatccccaggtagcctgtgtgcagggtatagagtgaaaggccctctccactgccaaggacgagtaactaagttctgtcaggcacctactctgtactgggtcatgctcctccaacttgaatgcacactggaattgcctaaagagctctaaaaacactgatagctctttaaattcattttatgttatgtgtgtggtctttgtttttttttaagagagagggtctcgctccgttgcccagggtgaagtgcagtggtgtgatcttagcttgctgcaacctccacctcttgggctcaagtaccttctcctcctgcctcagcctcccaagtggctgggactacaggtgcatgccaccatgcccagctaattttttgtatttttgatagagacaggattttgccattttgcccaggctggtctcgaactcctgggctcaaacgatcctcctgcctctgtctcctaaagtgctgggattacaggtatgaatcaccaccgttatgtgcattttgcatcaacaaaaatatacatatttatatactagtggatgtggcctgggcatcgggatgtttttaggctccccaggtgtttctggcgagcagcccagtttgagagcagctgtgttattaaggctcttccctgctccatatcatttcgccctttcaacgtaagagctgggtgctcttatgtccattttgcaggtagggaaactgaggctagaaaaggctggagaacctaagccaaggtcacggggtaagatgcacagctgggatttgaacctgcttctctgagtctctgggcctctgccctcagcctgctggctgctgactgctcctccgtgcgctggtggaccctgacgctgcccccagtgtgaggggacaggctggatgctgggggtgtgtgctggggcggagtggacattggaggacagctggtctgtgtgtgcattttttatttgaggctgggaggcagaagtcttgatggatgtggggtggaggcacggccgggtttccctctgacacccgacccagttccactctgagaagtccccggcacctttgctggtgcagtgcttggctgactcagctctgaccatcccctctcttctctcttggcagtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaa

SEQ ID NO: 361 - DNA, 13653 bp, Homo sapiens
  source 1..13653: mol_type = genomic DNA
cacttagccaggccgtgctgtggggccaggtcctccagctcataagtggcagccgcctctcagctccatgcccttcccaccccatgtcttggcaggtgagcacctgcacccaaggctcacagatgcttcagcaccaacctcattctttagaaagagtttgggggaggcttcatagattgaacacccgtccctgtagcacttgatcatagcaagacaaaatgtaaaacagcagatgaggccatggtgtaacgaactcccacacacacagcctgcagctgccctggggcccaggatgctggcccccaaaggtctgtcccagaagaggcattcgggaataagagtaacagcatgcgctctgccccagtcacttttctgagcactttacttgcattgggtgaatagcattatcatctccatgtcacagatgaggcaaccggggcacaggaagaataagtaacttgtccaaggcaacagagctaggaaggggcagagccaggtttgaacccaggaggctggctccagactgtcctttgccacctgggagggagctcaaggggctggggtgatgggctcccggctcctcccagggccccgctgtcctgatacctgattttcctccaccccgtccctctctccctcactcaggccaccagtgacttctgtgtggctcctgacaccttcatcctgaacgtcacggagggccagatcagcacaggtaactacacactctcaggctgctgctgtggatgcataggtggccggactctgtgcccctacttacctctttcagccctgtagccatccaacccctcctcaaccctgaacttcaagtccagctcatgctctaggccatttcctagaaagtgcctcccttgggagctcagggacggggagggaggtctggcttggccaccaaggatgatagagatctcatctggtcatttgtgagctgcctaacgttatgccgttgccctgcagaggtgactcgctactacctgtattgcagccagagtggaagcagccccttccagcaggtatggccccccgaggcctgccctcaccctgcccacagccgctcccccttgaccctaagcctcaccactgaccaagatggcggaggtggcagggccttgcttgcctcactgtggtcctctccttagctgcttctgtgaggggggcgtgcttttggtcgtgggttctagattggtggttaacacatatgcagctcaatgcgggagctagttcccatgcagatgctgtccaggagctctggggtggggccgagattctgtactactcacaagctcccaggtgaggccagggctgctggtccaaagaccacatctgagctgcaagcagggagaagactgtgcagctctcaagaagccagaggagtagggggagacttcctgcaagtggaggggcctgtgcagctgcagccaggtgggggggtgggaggggcaggagcataggcccctcagccactgtggggctcctgggagacggagcctcactgtggggctcctgggagacggagcctcactgtggggctgtgtctttcctggctcagaccctgaccaccttccagcgcgcacttaccaccatgcagatccaggtcgcggggctgctgcagtttgccgtgcccctcttctccactgcagaggtaaggcagctgtgcaggaagaggggagccccagatgaaccctgacagccctttcccctgccccggccccagggccaggctgtgcacagcttgctgctggctctctgttctcccgcccccgtgactcggctccctcccttggctctagaggcccctgagcacagctgctgtggtggttttctccgccagctctcctccacagcccctcggcctctctcgctctcttcccgcttcaggaagacctgcttgcaatccagctcctgctgaactcctcagagtccagccttcaccagctgaccgccatggtggactgccgagggctgcacaaggtgcatggggaccctggggtcacgtggagagtgtgagggcacccagcaggccacaccttccagagaaaagccggtagaggccgaggggagcgatggcctgggtccccttccggcccaggaatggaactgaagccagataatgggaagggagggggtgcctggcttctccaggggctgagacagggagactcagtacaagggaccaggggttcgggatgggagggttggatgcggttggctctgggtcactgggggaccctgaacaatgcaagggaggctgttccccattgtccagactcctagccatttcctcaacacatctgtctccctgggttgcaagtggatgtcccaatcccattgccagagtcttctttccaggaacttggaatatcagacagacacaatgatgcagggaacacatggggagcacgtgagagccccccacccaaaagcagtgagccagtgtatggcgacagctttcacatcccagatggatttagtgcagacagtctttgtcatcatcacagctgtcagctccatgcttggccctgttctgtgcattttatatccagtatgtcattcagttctcacagttatactgtgaaccacacgttatttcctaggaaattgacttgcttgtgcgtgtgtatggatagatccatagatacagctatgtgtgtgtgcacgtgcgtgtgtctgtgtgtgtgtgcgtgtgtgtgcacttgtggtgtatatgtctgtgcgtgtgtggtgtgtttctgcggttgtgtgggtgcacatatgtgatgtgtgtatgtatgtgtgtggtatgtgcatgcttgtgcgcatgtgtgctgtgcatgcgtgtgtgtggtgcatgtgtatgtgcctgtatgtgtgtgtggggtgtgtggtgtgtgcgtgtgtgtggtgtgtgcatgtctgtgatgtgtgtggtgtgtgtgcatgtgtgttgtgtgcacatgtgtgcacatgtatgtggtgtgtgtggtgcatgtgtgtgtgcatgtggggggtgcatgtgtgtggggggtgtgtgtgcgtgtatttataaagtggcttactgaagagtcccgagttggcacatcaggggcttgggtttagatcctggtagtctgacctcagagctaagaacatggcagtcacccctgtctcctctcttcttccccttctacatctaatccccagcaagtcttggcagctctcctctcagctgtaccctgaatccatccatttctctttctctccatggcttccaccacgatccggtcctgcccctccagcagacagtggcctcttcccactttctcttgccccctcaccacccatgagctttcacacatgcaaccagagcagtccttttgcagactaggttggatcacatcccttccactcccacaccctccaatgtctttctgactccttttaaaagtccgtactcctctcccgcattgcaaggcccagcacgacccagcccctgctggcctatgttctctctctttcctgaacaggccaagcctgtcccctttgccccctcttctcaaggtgtgctgcttcttgccatcctggcctcagcttcagtgcccccgtctctggttccccaccctgcaacctcctccgccctgttcagagccagcttcttagtgcccagctcacagtaagtgctcagcaaatgtttccagcgtgaacccaagaagccccattgtgttaggctccagagtgtggacctttaatggtgctgcaaggcgctcgggatggggagcagccaggagaccccaggtccaggctcgggggagagggacttccagaggagagctcggcccgcaggctttgcccccgctccttcactagctgcatgtccctcctcttcctccaggattatctggacgctcttgctggcatctgctacgacggcctccagggcttgctgtaccttggcctcttctccttcctggccgccctcgccttctccaccatgatctgtgcagggccaagggcctggaagcacttcaccaccaggtgggctgcctagtaaggaggggagcctcccacagcctggagttctgggagagcagcagacaggggcctctgctctacgatttagctgataacccaggactgaggagggcagcagagggcccgggcattcagcccaacaggctggctgacttctacagaagcttccccaagagtccacacagaccctccaaaggagttcggtggggcccagagcaagagctggggcccagggtggtgacagccctcaggccacagtctggcctcccttctcctctcttctcaccaggactttgcgatctggaatgaggagagttcttggtgctgggaggggtgccccaggaatagcaagaaggatacatggggtcactgttttcagggagcctgcagtccccttgaggagatgggcagggacacatggtgtacaggcacctggtgagcggattaggcaagaggacgcagggtagtggggacccacatgcgcatggtcagcgtggtggggagcctggaagagctggtcgtgaagctgggaatgggccagaatgatctgcaggaggcaggctggggaccgcgttttagaggagtctcaaggagacacgcgtggccagagagtcctgggaggaaaggcagggaagtaggacaggacctggctgcctcggagcctccttcacccttcacagccggccatcttctacccattgttctagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgtacggcctgcacacacacccaggctgggtagcactgcccggacagcatgttgggtggggtccacagtgccgggtgtggggaggaaggcatccaaggccacccgtggtccccactacagccacagggtgcctggagggaaggcccccggggagcatctagtcacccctccacacccacatgtgctgggggaagaaaccactgatgtcagcagcctctgccacaagctggtgggacaggtctcaggcccaaaaagctgcatttctccaggccatgctgctcccagcctccgttgcccatcagccacttgtccccaggcttcccaaggtgctcttctccatatctgcccactgcaccccctccactctatctgtggtttggttccatcccccacctcccatgtgctcacccatgggaccctcctgtagaaatctacacacacccccactcccacaccatcccctcctgagctctcctctcatccccgcaggaaccaagccatgctctttggtaggaacccacgctacgagaacgtgccactaatcgggagagcctcccctccgcctacggtaattggggctctggcccttccttgttggggtaatacataaagacaaaacctcctgccaacccagtgaatcctgtccacaaaggcagaaaagaatgaaactgttctgttattgaatatgcactaaaccagaccgtcgtgggtatcccaggcagtccgctaaggagattgcaaagatgcaagaaatctcactccttcccctagccaggcaggaacaagacacagcccactgcatacctgtcatccagcaagaggacttgacggcactgtttgtcacagtagtccaccttaatccacttgctaattggggtggccatcctggttaagtaattgcctttatttatttatttatttattttttgaggcagaatctcactctattgcccaggctggggtgcagtggcgcaatatcggcttactgcaacccaggtttcaagcaattatcctgcctcagcctcccaagtaggtgggactacaggtgcgtgccacaacgccaggctaatttttgtatttttagtagagatggggtttctccatgatggccaggctggtctcaaacttctgacctcaggtgatccacccgcctcggcctcccaaagtgctgggattacaggcatgagccaccgcgcccggccagctaattgcctttatccagaggaaaaataaaactcctatttccgtgacaatcagatagctacaacttggagccaggcccctaagtgaactgtcactgagaaggagatgaggtgctgtcttcctgatgtttgtacttccaagagatggctcccagacctgaaaaaaccatacctggattgtaacactggcaagggccatattcagcctttaagaaggtttgcagacatctcaaaagacagaaattatttacaatgataagttttctaaaggaaatactgcaagaagagagggggtctctttccctttttgctccagagaaaattaaggaattttttttctttttagatttctgtttaccttaatccttggtctcttttgggctggacggtgggttggctgtggtggcgggtctgggagggctgaacccaaacacagccttcctcaatccgtctcagctccccatgtccctaggactgtgcccaagtagggccagtgcctcttgtccaccccaccacctccagccagagtacctgagatacagcctcaggggagtagctcagggtgggcaggttgagaaggaaagactatgctgtctcatcccagagaagtatccaaaggacacagaaatactggctgagacaaagaaagctgtaaacagacagtgaagtgaccgccaaggttcagggacacggactccagtgccaaaggcctgggttcaaatcccagctcatggcttatggcctctgtgactttggacaagcactttgctgctctgtgcctcagtttccccatctatagaatgagtatgggaatactagcacattcctcctcggtggtgtgtgcaatgggcaaattgattgttatcagagcgtacgtgcgaagcatccagtgagtgccgtaggacagtgagctgttatttgtgactttcttccaccccaccttctccacagagctgtggcatttatcaattttattttattttttattttttatttttttttgagacggagtctcactcttctgcccaggctggagtgcagtgatgtcatctcagctcactacaacctccacctcccaggttcaagtgattctcctgcctcagcctccctactagctgggattacaggcatgcaccaccacacctggctaatttttgtatttttagcagagacagggctggctggtcttgaactcctgacctcaggtgatccacccatcttggcctcccaaagtgctgggattacaggcatgagccaccgtgcccggccagagctgtggcatttataagaaaggacaaggggaatgaaaggccagaagtctgccatggggtgggcagaagggtcctggagccaggcatctcccttcattgggcctggcgaggcatttcagtgccccgacccagatagtttggaaggggacatccaacaggaaagcagaagcactggggcccaaatacctgggaccagcgtgatagacctgggccctgaggacccaggaagtgcacgcacaggcacccagggagtcagcttcccggtcatggcgcttggtgaaaatcatagtgtcagacccgagaaaagagcaagtggaacccagtccctgtcttcaggaagttccagtctatagaaggggcactcaagaaggctgcctgtagaaagtgctacaaggtactttgggaccagaaagaaggagccatctttgctgctgctctaggggattccagaaggttctatttaataggtggcgtttgagccacagtgtagagcaggggctcacccaggggcagttttcccccctggggacatttggcaatgtctggaggcattttcattaccacgcttggaggctggggatgggggctggatgctattgacatctagggagtggagcacccaccacaaagcacggtgcagccccaaatgcccataggttatggggcctgtcctctgcgtgtgggatgttcagcagcatccctggcctctacctgctagcaagcctgctggaaccaatccccctgtcattcactcctgtgccaccaccttggtgcttttgcctggagcacctcacctgctgtcccatcccacagctttacaaacacaagccccagcctcatgtcgttctttcttcctggggtccccgggagtgggctggttgaacctgtattcaaagtcagcaccatttattatttatgtttatttttttgagacagagtatcactctgtgacctaggctggagtacgtggtgcaatctcagctcactgcatcctccacctcctgagttcaagcaattctcatgcctcagcctcccaagtacttgggactataggcacgtgccatcacacccagctaatctttgcattttcagtagagacggggtttcgccatgcaggccaggctagtctctaactcctggcctcaagtgatgcacctgccttggcctcccaaagtgctggggttacaggcatgagccaccacgcccagcctaaaagtcagcaccttttaaatgccagcctagcttctctcactaatcagaagcctcccgggttcctttttccaaccaccagctgccgtggccccaggaatgcagattgactttaatattaatctaagcacaacgtaattaggggaaatctgctgtgaaaaaagaattactctatgcactgtgatgccaaataaaaatgattttcagattcccttctgtttgaaagatccaggccactcatcctgccgttagcagagataatcagcaactgaccttatttgcaaggctcaaggacagaaaacccttcctccctagatttaagacctgcccagaaacacttattgctttggccaagttgactgcccagtcccacctagcccagcctgccctgggaagacccttccacctccatgcccggtaagggacctagagagacatctaatgatgccgcagaccaaggaaccccacagcatggagggtgtgggtgtctgccccagtaaagacagcacagctggctgcgccccaccctccccggggcgcctgctctaaacactccttagcaccgagcaagttcgagaggtggataaactcctccctctgccgagcaccctctctgggacagtcaggggacctcactgggtgggtgatgtcacgcctggtgatcgggatatacagcctgtcccttgctggaaatgtttcttcccccagctctgccttcaaggaataatctctcctgtccttttaggcactgtttcttggacttgatgaacaaaaatgacccagggcagttaaagatactgacgttgagacttctcttcagacttacagaaacagaatatcttggggaaggagcctgggagattctaagtttaacaaacttattatcattcaagttgggaaatattgctttaagaaggagggtcttggccagcaccatgcctcatgcctgtaatcccagcactttgggaggccaaggcaggtggatcacttgaggccaggagctcgagaccagcctggtcaacatggtgaaaccccgtctctactaaaaatacaaaaattagctgggcatggtgatgggtgcctgtaatcccacctactcgggaggctgaggcaggagaatcacttgaacccaggaggcggaggttgtagtgagctgagattgcaccactgcactccagcctgggtgacagagtgagattctgtctcaaagaaaataaaaaagaagaaggagggtctcatacttgcgtatgcatcagaatcgcctgagggacccaccctgtttctgattcagaaaatctgagttggagcctggagatgtgccttttttgtttttttgagactgagtttcactcttgttgcccaggctggagtgcagtggcataatctcggctcactgcaacctccgctccccaggaccaagcgattctcctgcctcagcctcctgagtagctgagattacaggcccccaccaccacgcccagctgactttttgtatttttagtagagacagggtttcaccatgttggccaggctggtcttgaactcctgagctctggtgatccacctgtctcggcttcccaaagtgctgggattacaggtgtgagccaccgtgcctggccggagatgtgcgtgtctgacatattcctaggtaaagctgctgctgctgccctggaaaccacgcttggagaaccactgctctgaggccagcttcttcagcctcagtgctattgatgggcagcgtcattctcggtggggggttcctgtacattgtaggacgtctagcagcatccctggcatctacttgctacatgccagtggcagcccagtgcccagttgtgacaaccagaatatctccagacattgcctaatgcccctgggaggtaaaaacatccctggttgagacccactgggtcgaaaacctcatgctccctcctccccaaccccagcccaagtggaagcattccattccccctgatgtgaatggcctggacccctgaagcttcccgggtcaggagagtggcagtttctggaagcttgttagaagtgcagaatctcaggtcctgtggacaagatccccaggtagcctgtgtgcagggtatagagtgaaaggccctctccactgccaaggacgagtaactaagttctgtcaggcacctactctgtactgggtcatgctcctccaacttgaatgcacactggaattgcctaaagagctctaaaaacactgatagctctttaaattcattttatgttatgtgtgtggtctttgtttttttttaagagagagggtctcgctccgttgcccagggtgaagtgcagtggtgtgatcttagcttgctgcaacctccacctcttgggctcaagtaccttctcctcctgcctcagcctcccaagtggctgggactacaggtgcatgccaccatgcccagctaattttttgtatttttgatagagacaggattttgccattttgcccaggctggtctcgaactcctgggctcaaacgatcctcctgcctctgtctcctaaagtgctgggattacaggtatgaatcaccaccgttatgtgcattttgcatcaacaaaaatatacatatttatatactagtggatgtggcctgggcatcgggatgtttttaggctccccaggtgtttctggcgagcagcccagtttgagagcagctgtgttattaaggctcttccctgctccatatcatttcgccctttcaacgtaagagctgggtgctcttatgtccattttgcaggtagggaaactgaggctagaaaaggctggagaacctaagccaaggtcacggggtaagatgcacagctgggatttgaacctgcttctctgagtctctgggcctctgccctcagcctgctggctgctgactgctcctccgtgcgctggtggaccctgacgctgcccccagtgtgaggggacaggctggatgctgggggtgtgtgctggggcggagtggacattggaggacagctggtctgtgtgtgcattttttatttgaggctgggaggcagaagtcttgatggatgtggggtggaggcacggccgggtttccctctgacacccgacccagttccactctgagaagtccccggcacctttgctggtgcagtgcttggctgactcagctctgaccatcccctctcttctctcttggcagtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaa

SEQ ID NO: 362 - DNA, 40638 bp, Homo sapiens
  source 1..40638: mol_type = genomic DNA
caagcaaccggtaaacgccgccgtttgaggagcaccggagccgcgaccgtggattgaacgcttccccagagacccagaagcagaaggagcggacccagggtaaggggcgggcgccaggaggacgtcggaggctaaagactagagtggagagtgacagggagagacttacagggtaataaccaccaagagtgccaaacattcctcttggggggcttccttctgggatagctctgccagatggtggctgccaggactagcgctcctagtgccctcttccccttagtcctcgctgccctggatccgccccaagtcgcaggaccctgcagcctctgtacaccctgcctcataccctcctacccactcaggtcctgatacagtccttgtcctggagtggactggagacctctgaaggatttacagctgaatggatggaaaaaaaagaagaaaaacagcctccggctagggtgatgggaagatgggccctttaagaggagagctttctgctcaggatagagggatgtaaattaacagtattgcacacctgctaggtggcaggtgttttaagtgctttctttcatttcttcctcaacctgggagctggcgttctcgtgtgatcgaggtcatacagttggtgagttcctccggagcgtgtgcagttcctccttcctgctcaaggtcaaggtttaccacattctcttgaaccacagaagtgcgtcttctcccagctttcagaccctatgtgttttcctctcgaatccttggtttcaaatcctttgcttgtttgtcacggtcagcagaggaggaacaggggagagagctgtagagagaagcctggtaggcgctggtatcacagtcactaacgcagcaggtgacaggagtcttgggccccttctatgtgccagtccctggggacgggagtgaataaaagaccacagtctttccgtcaaggagaccacaaggtagttgtgagggcaggtagtcactgacccccatcggtctccaattctggggacctcttcccaactcgtcctgccctcaaccttcactttccttggggggctcagccatgcttagtgctatcctgggggaaaataaatgggggctttctagggaggtctgcctcttttgagggtagagtgagtccctcaggaccccggaattccagaaggtgcacaaggacataagaaagagaaagaaagctgggtgcggttttcacacctgtaatcccagtgctttgagaggcccaggaggatggatcacttgaggtcaggagtttgagaccagcctgcccaacatggtgaaaccccatctttactaaaaatacaaaaattctggccgggtgcagtggctcacgcctgtagtcccagctactcggcaggtggaggcagaagaattgcttaaacctgggaggtggaggttgcagtgagctgagatcaggccactgcactccagcctaggtgacagactgagactccgtctcaaaaaaaaaaaaaattagccgagtgtggtggcatgcaccagtagtctcagctactcaggagactgaggcacaagaatcgcttgaacttgggaggcagaggttggagtgagccaatatcacaccactgcactccagcctgggtgacagagcaacactgtcccaaaagcaacaacaacaaagaaagagggaaggaagtcctctcctgccaggtgccatgcagggcccaccactcgcaggaacccagtaggggctgtaccagggaccaagaagaagaggaaaatgttctcatctccttattccactagggagttcaatgtggagggctgaccttccagcttgcctccttcccagtctcccacgctgacactcctcctccccatcactcccttggccttcctcccagcttggaaaacacactttcccttaagccaccggaggttctctccaggaattactttgctcattctcactgcacaagacgagttttgtttttatagtgagtgaaggttcccatctgactgcctccccggggatgcgggagacgcctgaatctttgatgtctggaccacagcgtccctgattctgcgtgttcctgtgtttgagactcacagtggtgttcttcacgcctctgggactctaggttcccacggggggaggatctccccccaaaactccagagggcagtgacactgctcccgtccccgctctgtcaccccatgcagacactcctgctcaggccttgcttggggaagcccaccctctagcactagtctcacaagaggttgggggagacctcctgagacgccctttgctgaccttgctattcatctgtgtgccctgctagcttgtgagaagagcttgctctgggtccttgaatgggttgtcttcccgtcaccaggccagtctttaaatgtcccctctgtctgcctccagacacaagacaatgcctctgttctcactcggggcttggccttgggaaacaccaagaaggaaagcaaagctgttaaaaatctgatctgggctaaagaggctatttctgtcttcctggagtttcctcattctcttcaatctccttgtgtcccctaggagccagctggcttgcagcaatttcttttaaaagtcagagacaggcagccctaattgcctgagtcctgcagccccatgtgggaggcacagttgcttcacactgtgttggcaaaggggaggatgccacgggatttgcatgctttttcacaaggccgtagctttgtccatgtggtaaaaacacactggggcaccccgctacaatctgggcttctcatcccaccctgtgccctctaagccattgctcccacccaggaaagagaatttccaaactacaagaaagagaagaaaacaaggctgggtgcggtggctcatgcctgtaatcccagcactttgggaggccgaggtgggcggatcacttgagatcaggagttcaagaacagcctggccaacatgctgaaaccctgtctctactaaaaatacaaaaattagccgcgaatggtggcatgtgcctgtaatcccagctacgggaggctgaggcaggagaatcgcttgcacccgggagacggagtttgcaatgagcctagatcttgccactgcactccagcctggacgacagagcgagaatccatctcaaaaaaaaaaaaaaaaagaaaaaagaaaaaaagaaagaaaatgccactttctgcaacagtctggttaaggttgagttgctctggggctaggagtgggatggggtggtactgtcttcaagacacaatgtatatggatgcaaagggttaaccttcctaccctccttctccccacctgctgccccagctgctccagggcccaagttccccctggcacatgcttctaggggcacacagctcctgccctgcctctcaggggccagcggccaggacccactggtctggtgccttgtagccctggaggcgggagagggtaggtaagacacaggtctggtagtcatgttcacctagggtgattgtgaaaaacacgaattgctaggccctgccccaggcatctagttcagcatttgcaggagagaggcctgggagtctgtgtatttttaaggaagatcccaggtttcagaaacgctggttgagagattaagttccctcactttaaatcaatggtcctcaaagttggctacacatggaattgcctggagaattaaagaaaaaaagcatatactgatgagagattctgatgtagttgttctggggttcaaacagcattgtgatttcacaaagccctgcaggtgtttctaaatgtgcagtcaggactaacaatcactgctttagagccagacatgcctggtggttctgcctgaactgaagaactgtgacctttggccctgtattaatacttcatctctccaggcctcagtttcttcatctcgaaaatgggctcatgcctataatcccagcactttgggaggctgaggcaggaggatcacttgagcccaggagtttgagacaagcctgggcaacatagtgagaccctcaactctacaaaaaaaaaaaaattagtctgatgtggtagtgtctgcctgtggtcccagttactcagaaggctgaggtgggaggattgcttgagcctgggaggttgaggctgcagcaagctgtgttcatgccactgcactccagcctggatgacagagcaagacactgtctcataaaaagaaatgttagtgagaattgtgatcactctttgggagtggtgctgggcatgcaggaagcacgcctggaaactgttgttcatagtgcttgcaacctggtcagtctttacatattctggatgcaagttctttatcaaatagataatttgcagatattttatccaagtctgtggcttctctttttgttaacattgttggccgggcatggtggcgcatacctgtaatcccagctactctggaggctgaagcaggagaaccacttgaacgcaggaggcggaggttgcagtgagcagatatgccactccactccagcatgggtaacaaaatgagattccatctcaaaaaaaaagaaagaaaagaaaagaaagaatgaataagacctactatttgataggacaacaaggtgacaacagtcagcaataacttaattgtacatttaaaaataactaacaggccgggcgcggtggctcacgcctgtaatcccagcattttgggaggccaaggtgggtggatcatgaggtcaggagatcgagaccatcctggctaacacggtgaaaccccatctctactaaaaatacaaaaaattagccgggtgtggtggtgggcacctgtagtcccagctacttgggaggctgaggcagaagaatggcgtgaacccgggaggcggagcttgcagtgagctgagatcgtgccactgcactccagcctgggtgacagagggagactccgtctcaaaataaataaataaataaaaataactaacaaaggataaattcttgaggggatggataccccattctccatgatgtgactattaatatctagtatttgatagcacaacagggtgactatagtcaaaataatttaattatacatttaaaaatagctgaaagagtataactggattgtttgtaacacaaaggataaatgcttgaggggatggatggataccccatttcccatgattgtatattgtatattgcatgcctatagcaaaacatctcctgtgccccataaatatatacacctactatgtaaccacaaaaattaaaaattaaaaaaaaatagcaaaacctgctcacaggcaaacctgctcacgtaatcctgtttttgagatagagtcttgctctgtcatccaggctggagtgcagtggcacaatctcgactcactgcaacgtctaccttccaggtttaagcgattctcctacctcagcctcctgagtagctgtgattacaggcacgtgccaccatgcctggataatttttggtatttttagtagagatgggttttcgccatgttggccaggctggtcttgaactcctgacctcaagtgatccaccggcctcggccacccaaagtgctgggattataggcatgagccacaatgcccggcctaatctcttgggcgttgaaaggcctttggttgtaaatctaccaaggcaagctctccttcagtttatcttcctcccaccagcaccagccactcatccacatcttttgtcctaaggctctgtgcaaccccaggagccttgcacagatcctcaatctgagcccctggaaacttgctatcaaaggcacaatttctgaaagtgcaggtggctggcagacggaaatctctgctaattccatggtgtgatatggcaggtacacaggtcaaagcgccaaccactgaactcattgagaaagccctcagacccagtggagtctagtgatgtcatgggggagtcagaaaggtcaagggcaatatgtgggaatggcccagcccattgcatttttacaacttctaatcagcatcagtgagaaacccttccttgcgtggcctgtgaaccccgcctctgatgctgctggagcactttcatttcacttctcagcatcctgtgggtgtgtcaggtctcagaaagactaagtggccctgcctaggtcacgcagctggtgacgggaggcccagaacttgaaatcagggccgagcccagcccacttcccaattccctgctgtgtcccatgaccagtagcacgcgtcagaggctttcccaaaggcctccatgtcccgcctgttggggaagcccctggctttctctctgtctgggattgactctcagctctgtcctggttggagagaagagatttccaggatggtacccagacagtggtggaggccagagtctggcaaccaacgagccttttggacaattgggtggggagttgggtcattgggttggagaggaggggttcaagaagaggcccaggggtctcaaatctgtgtcctgtgtgtttcatgcccagcatggcagggaatttagtccaacatcatcaccatcaatatttcctcctgccctgtcaataaacactgattcagtaaaaaccgtattgtaccacgtgcgatggctcatacctgtaatcccagcactttgggaggctgaggcaggtggatcacttgagcccagaagttcaagaccagcctgggtaaaatggcgagaccccatctctacaaaacaatacaaaacttagccaggcatggtactgcacacctgtggtcccagctacttgggaggctgaggtgggaggatcacttgagcccgggggttgaggctgcagtgagctgtgagcacaccactgcactccagcctgggtgacagtacaagcctttgtctcaaaaaaaaaaaaaaaaaaaagccctaaaaacaaaagacgaaaactgtatcatttggtgggtaagagctttggaatgggggcagaccagctgcagcatgcattagctataggaccttgggcaagtcactgatggcatctaagcatcaaatgccttcaaagaaaatggtgattttatttatttatttattttgagacagagtcttgctctgtcacccatgctggagtgcaatggtgtgatctcggctcactgcaacgttctcctcccgagttcaagtgattctcccacctcagcctcccgagtagctgggattacaggtgtgcaccaccatgcccggctaatttttgtatttttgcagagatggggtttcaccatgttggccaggctggtcttgaactcctgacctcaggtgatccacctggcttggcctcccaatgtgctgggattacagttgtcagctaccgcgcctggccaaaatttttattgccctcctcagagagcaactgcaataactaaacagggtaatgcttagcatatagtcggcactcaggatttttttttaatgcggatgcagcttctggacaaattcctaggatctccccaccaccccttgcttcctgccccaaccagattgagaacctggagctgtcctggcaggacctgtggagatagggaaggggccggtggggtccctcaccccacaccctccctctgccccccagcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggtgggtccctgccccaagggccctggcctgtcaggtgtggccaggcagggcggccagctggggccggtgagtggttctgtgggtccttgtccacctgaaagccagttagagtagaccaaatgcagatgctggaagtgagggcagaggctccccctgagttccacgcagtgctcagggtcagaggaagacccagcacccgccttcctcgagccagggaagtgcaaatcacaatgttccctctcccaagagctcttgtttcacctcgaagacacttaccagagttgttttggatgtttggtgtagctgggagacattttttttttaaacagggtctcactctatcacccaggagtgcagtggtacaaactcgacttactgcaaccttcgtttcctgaattcaatagatcctcccacctcagcctccctggtagctgggactacaggtgtgcaccaccacgcctggctaatttttgcaattcttgtagagatgaggttttgccatgttgcccaggctggtctcaagctcctgggcccaagtagtcctcccgccttggcctcccaaagtgctgggaatacaggcatgagccactgtgcccagcgtgggagagatattctgagggagcagagattcatatctacaggcaactacccagcttgagaaaagggaagtgtcccacagaaagttccagccagaggggcctccacgataagagaacttatcttgagggtcatggtcatgtgttcagaggccaaaaattccctgtctctatgaactaagtgattcaccctaattaggtcaacaactgctgagataaaatgataacgaaatcacttgatttggccaaaacacgtccaacagtcaggtgggtgtgggtggtttcagtgactcacagttcaaatgaattaggtgcttctctcccaggaccaactgctcccccggggatgagaaggactgtggccatggtgtagccaataagcagaatggccgctatgtgggccacaccctgggggccctcctgtcgtttccagcagctctgccttttccagacttgttttgttttgttttgttttgttttaacctttcctatggtgctgatccagattttaccttttgtgagagctggcttaaaaatggaaaggagatgggagtgacttcatgaggatggggtttccatcctgggtgatgtaagagttttggaactaggtggggttgatggttgcacagcactgtgtataataacgctgctgcagtgtacgctttaaagtggttatgtggtaaattttatgttacatgtattttaccacaatttcttaaaaacaggaagggctgggtgtgctggctcaagcctgtaatcccagtactttgggagaccaaggtgggaggatgcttgaggccacgagtttgagaccagcctgggcaacatagtgagacttcatttctacactttttttttttaattacccagttgtggtggctcgcacctgtggtcccagttacttgggaggtggaggcgggcggattgcttatgccctggagttcacagcagcagtgagctgtgattgcaccactgcactccagcttgggcaacagaatgagaccctgtctctaaaaataaataactaaataactaaataaataatttttaaaaaataaagtgaaaagaaggcagaggcgagaggatcacttccgctcaggagtttgacaccagcctgggcaacatggcgaaacaccgtctctacagaagaaaaacaaaaacaaaaattagccacgtgtggtggtacatgcctgtagtcccagctacttgggagtctgaggctggaggatcccttcagcctgagaagtcaaagctgtactggccgggcgcagtggctcatgcctgtaatcccagcacttccagaggctgaggccagtggatcacctgaggtcaggagttcaaaaccagcctggccaacatggtgaaaccccgtctctactaaaaatacaaaaattagccggccatgatggcgagcacctgtaatcccagctactggggaggctgaagcaggagactcacttgaatccaggaggcgaaggttgcagtgagccgagattccgccattgcattccagcctgggcaacaagagcgaaactccttttcaaaaaaaaaaaaaaaaagctgtagtgagtcaagatcatgccactgcactccagcctgggcaacagagtgagagaccctctcttaaaaaaaaaaaaaaggaaagaagggaaagtggcgacacccacgtgtaaaactgtcctccctgctagagaggataggcaaagcaaatccaaacttggagttttaacgttcaatttttgtgacactgacattgtcagtgatagggtggcattgttaatgatagagtgaagaaaggctattcactttttcttttttctttttctttttttttgagacggagtctcgctctgtcgcccaggctggagtgtagtgctgtgatctcggctcactgcaacctctgcctcccaggttcaagtgattctcctgcctcagcctcccgagtagctgggactacaggcgcccaccaccacgcccggctaatgttttgtatttttagtagagacggggtttcaccgtgttagcgaggacggtctcgatctcctgacctcgtgatctgctcgcctcggcctcccaaagtgctgggattacaggtgtgagccactgcacccggccaattattcaccttttctttggattctcacagagcagatggacaggcttctctggtccattagaattcagataaggtcagaacaggattttcatgaccacagctaccagttgcaaagctgcttagctccacagggttgcgctgttgcagctacctgtgcccacctgatcaccaggaatttccttgcctgcatttgaaaatactgtggctccggccagggcgcctcagcatccagccctgggagcccccgtgggacctggcttgcagaagtggccgagggtttgggagtataccagggtgacgtcttccctcctgcggctctctgtttaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctgtaaggcttcctcctgccccagctgcaagagccccatccatcactgcagctccccaagggatgcactgccccagctgtgcctggccatcgctgtgaggctcgtgtgaatgctggggggaaggggaccagctgctacctcaaggagccttctgtctgggagcaggcagaggtcccaatcacagaccaacagggaaggcagggaggtacaagggctgaccaggcatcaggaggagtctgaccttgggcaaaggtgactcccaaagtgccccacccagcagccaatagggatcattcattcatttgacaaatttggactgaacttcaagcctctgccaggcacagtagaggttgcaaaatgaatctcataattgttctacatacttgccagtgcaaaaaaaaaaaattgttttaaggaaaaagaaatttaaaatttaaattaaaagaaaaagaatctcttatacatcctgtcccaaagagattgcagtccattggaggtcaaagacaaatacagagacatcaccagataacataaaaagaaagaaatgctgaaagagaagcatgacttgtcctttgactccatgaggagggagggtcaatctcctgctgaagggaacagggaaggcttcctggaagaagtggcagggcttggttgtcctttggtggacatttgcaataaaggggagggcattctggatggaggaaccagctgtctgcaaggacaggaagaaggagatgagtgccatatacacacacacacatatatatatatagagagagagagagagagagagagagattaataattttatttgggctgggcttggtggctcacacctgtaatcccagcactttgggaggcagaggcaggcagatcactcgagctcaggagtttgagaccagcctggccaacatagcaaaaccccatctctactaaaaatacaaaaattagccaggtgtggtggcacatgcctgtagtcccagctacttaggaggccgaggcaggagaattgcttgaacccgagagacggaagctgcagtgagtccagatcgcacccctgcactctaacctgggcagcagagcaagactgtgtctcaaaataataataataataataataataataataataataataattttgtttgtctagcatggtgttcttcaaccttttcttcattattggccttcatgttttttctaatggccttctgcctccataaaatgtttgttgttgttgagacagagtctcattctgtcacccaggcttgagtgcagtggcgtgatcttgggtctctgcaatctccacctcccgggttcaagcaattctcctgcctcagcctcccaagtagctgggattacaggcggctgccaccatgcccagctaattttcttttgtatttttggtagagatggggttttactatgttggccgggctggtctcaaactcctgacctcaagtgatccacccgcttcggcctcccaaagtgctgggattacaggcgtgagccaccgcacccagcccatcaaatgttaatgctatagacatactgtatatctgttcatgcgctgcatgtatttccatgctttgtacctaaaaagcaatattattttacccccaggaaccaattgaaaattcctccattgaaagcacatggttaggtggatgggaaaagcccctggctatgtcctgtccctcccagactccattgcaggcctgggcaatctgaaaggacctccatttactgcggagaacttccaatgtgtcccccctagatcatggagcactgcatcaagcagaacaatgccattgacatctatgaagagtatttcaatgacgaggaggccatggaagtgatggaggaggacccttcagctaaaaccatcaatgtgttcaggtagcgccatagccaggcaggtgtctggccaccctccgtcacccccatgcatgggcgcctccaaaggcaactccttgccatcgctgcatgccctgggtgcagcactgtctgtgctctgagcttgataagtgacgtggtgataagtcacccagcagagaagtggccctgctctgggggcgggtctggttgatggaaagggagtacagactccagagaaagtgaaattgcccagctgcgtacaggtggggcatgttcctgcagggcagagtaagtacaagtaccaagcatgagcagctagcagcactgtgggcacacaggcccccgccgcggcctgcactcatgcgagtatatccatgaataactccagaggatagaagtttgacaccagggattcatcccacaggttgtgtgtgtgtgtgtgtgtgaaatcaccgcaggcgtggatattcactgcagagggtgtatgccagccaaagactagaacaagctaagtccatccataggggactggttctagcagttctggcacacccacacgacggaatgccatgcacctggtaaagcgagcggggcagtctgggcatggtggctcacgcctgtaatcccagcactttgggaggccaaggcgggtgcatcacctgaggtcaggagttcaagactagcctggccaacatggcaaaaccccgtctctactaaaaatacaaaaattaactgggtgtggtggcacatgcctgtaatcccagctactcgggatgctgaggcaggagaatcacttgaacctgggaggcggaggttgcagtgagccgagatcgcaccactgcactgcagcctgggcaatacagcaagactctgtctcaaaaaaaaaaaaaaagcagtgcaacttcttatgtgctgatatggagtcatttccaggattcagtatgtgaaaaccaaaccaaaacaaagccggtgcagaacagggtgtgcagagtgccactttttgtggcagtccccaacttaaaccattttttgtctttgcaaggctgcaaaagcaatgcaaatccaggagaaaccgtacttcaagtacccatacaaccattctgttttccaccctcagtacagtattcagaaaattacatgagctgttcacctctttattataaaataagctttgtgctaggtgattttgcccaactataggctaatataagtgttctgagcacataggctggactaagatgtgatgctgggtaggttaggtgtattcaatgcattttcagctcctgatatttccaacttactatgggtttatcagatgtagccaacatcattagataaggagcatctgtatatgtgtataaatatatgcatatgtgtatgtgtgtatatatgtgtagatgtatgtttacatgcctgatgtgaggagaacatctgtgattttggacttctggcatccggaactgtgatagaatcaatttctgttgtttgaagccacgcagtttgtgggacctcgttgcagcagccccaggaacagaataccccatcccagagcacctttgtagggtgtacaaaagaagctgataggaaggagagcttgggaacagggatggggagaagcctggggaagaaggactcctcggccttgaagtctggtggaaggagttgcagaaagtgggtggaagtgagaaagaccatgctctgtggcctcggttttgaccatgaagaaaaaagcaaggccgtccaatcagatgagtggagatgagcaggaggctggaatagagcagctggggaaatgcggaggggaagcctgtggacctggggcagaggacagaccttgggtctgggtgatgcaggactaggggtgtgaaaggtgtttgggaaatgacttgcctcagatcccagctctggggaattcatttcactaccacgactgacttaggggcctgggaagtacctagcccagtcccagcacagcaagaaagaactcttttctgaggcagggctgactcatggtgtgcaagcagggccagtggctgtcagcaaggggtgtgcaggagagggcatggcggggcagaggctgcccttcctgttgccctccagccctgctgggctctaacctcgtatatggaccaccagagcaggatgatgcattagaaatcatccgaggggccgggcactgtggctcacgcctataatcttagcactttgggaggcccaggtgggcatatcatctgaggtcacgagtttgagaccagcctaggaaacatggtaaaaacctgtctctactaaaaatacaaaaattagccaggcgtggtggtgtgcgcctgtaatcgtagctactcgggaggctgaggcaggagaattgtttgaacccaggaggcagaggttgcagtgagccgagattatgccactgcctgggggacagagcaagactccatctgacaaaaaaaaaaaaaagggggagaaattggggaacctcacatccagccttctgctctcttccctctcccctgcagggacccccaggaaatcaagagggctgccacacacctctcctggcaccccgatggcaacaggaagttggcagtggcatactcctgcttggattttcagcgggcacctgtgggcatgagcagcgattcatacatctgggacctgggtgagaagcagcggggtcctggtggcctgggagggctgagggctgggaccagcacaagtggaggagcgggagggaggggcaggaggtcaaggacactcacgcggttggtgcctcaagggaagggcccgcagtcgaggaggaacacactcttctccttcctctcttgtctggtttcaggcagagccaagcagagtcaaatcagaagcaggaaacccccaccaattccagattcttagttcgaggcatgaagacctgaccccatgggatctcaattcttagctcctaaggagcatatcaggccgggctcggtggcccatgcctgtaatcccagcactttgggaggccaaggcaggtggatcacctgaagtcaggagttcaagaccagcctggctaacatgataaaaccctgtctctactaaaaatacaaaaattagttgtgcttgatggtgggtgcctgtaatcccagctacttgggagactgaagcaggagaatcgcttgaacccaggagtcagaggttgcagtgagccgagatcatgccactgcactccatcctgggcaacagagtgagactctatctcaacagcaacaacaagacagagtgcccagcagactgagaagggactcaaggggcggcggaatggaacttgtgcctttgtcccatctgtcctgacacttgcctttaattcatggcctgcaggggcagcgtgtccatttattagcacaaaccattgtctacagaagggctggcaagacacaggcagggacagggtggtggtggcttcacgctctccagcttcccttcgttgtcagcattattaaaataaacatgtaggtgccaggcagagagctaacgcccgacattccaacagctcagcgagttctggcagcagccctatggggtggactccgtcattatctgcagtccacagacctggttggaagaaaccggcagagagttgactttgtgtaaaaactttagtatcaaaacctcgtttcacaccaaacctaggaactggactagaaatataattatcacacacatacgcacaccccaatcctgttcaccaaaaataaaaaccatcagcaaagcccctagggtcaagaatgccagattctggccaaggtggaccagggggtgcaggctggggaaagactggaggggcttccaggcttccccctctgccaccatgcccccgctacccacccgcagaaggggtgaaactggttgatcctgtccttttctttccgggcctggtggggataatttttttgtgctttatagaaaaccccaacaagcctgaacttgctctgaagccatcgtctccactcgtgacgttggagttcaaccccaaagattcccacgtactcctgggtggctgctacaatggacagataggtaaggagggacctaggcttttttatttttatttttattttttttagatggaattttgctcttgtttcccaggctggagtgtagtggtgcaattttggctcactgcaacctccgcctcctgggttcaagtgattctcctgcctcagcctcccgagtcgctgagattacaggcacccaccaccacacctggctaatttttttgttatttttagtagagacagggtttcaccatgttggccaggctggtctcgcactcctgacctcaggtgattcacccacctgggcctcccaaagtgctgggattacaggtgtgggccaccacacctggccgggacccagattcatagtcagagccaatcctgctgctatagggcagagcccacatggcagcctgggctcggccacagaagactaagtggggtgagggcctcccatagctgaccaactgcagacacgggtgaggcaggtttggctgacacctcagcagtgtctcctgttactactgtaagtctaaaattagctcaaaataaacagttttaaaaaactatagttcaagtaaaatcagagaatatttgactaggggccgccataaagggatgatgagagcgttggggagccctattttgggagaggtttctgggaaacctacatgctaacggatatgggtaatactggccttatagaatgagttgggaagtattcccttctggaagtttgtgaagaattgatattaattttttttttttttgagatggagtctcgctctgtcgcccaggccggagtgcagtggtgcagtctcagctcactgcagcctccacctctcggattcaagtgattctcctgcctcagcctcctgagtagctgggactacaggctcatgccaccacgcctggctaattttgtcttttttcagtagagttagggtttcactatgttggccagacttgtctcaaattcctgacctcaagtgatcctccctccttggccttccaaagtactgggattactggcgtgagccaccatgcctggccgctattaattcttgaaatgtttggtagaactcatcagtgaagccatctggtccctggcttttctttattggaagcttaaaagttacaattcagtctgtttatttgttatagatcctcttcacattttctgtttcttctttaattgcttttggtagtttctgtctttctaggaacttttccatttcatcaagttgtctagtttgttgacatttaattgttcacagtattcccttataatcattttctttttctttttttttttttttttttgagacagagttttactctgttgcccaggctggagtgcagtggtgtaatcactgctcattgcagcctcgacctcctgggcccgagcaattcttccaccccagcctcccgagtagctgagcctacaggcatgtgccaccacactcggctaatttttgtagtttttttagtcacaaggtttcatcatgctgcccaggctggtcttaaactcctgggctcaagggatccgcctgccttggctggcctcccaaagtgctgggatgaaccaccacacctggcctgatttcagtcttttaaaatttattgagacttgttttatggcctagcatattgtctatcctggagaatgttccatgagcacttgagaagactatattctgcttattgtccggtgtagttttcctttttttttttttgggacggagtcttgctctttcgcccaggctggagtgcagtggcgcgatcttggcccactgcaagctctgcctcctgggttcacgccattctcctgcctcagccttccgagtagctgggactacaggtgcctgccaccacgctgggctaattttttgtatttttttttagtagagacggggtttcaccgtgttagccaggatggtctcgatctcctgacctcgtgatccgcccgcctcggcctcccaaagtgctgggataacaggcgtgagccaccgcacctggcctgtccagtggagttttctatagttgtctgggaggtcttgtctatagtgttggtcaagacttctatttccttgttgatctttcacgtagtaattatgtctattattgaaagtaggatactgatgtctgccattattattgttgaattgtctatttctccttcaattttgtcaggttttgcttcctgtatgttaaggctatgttattaggtacatgcacatgcttataattgttaagttttcctagtgaattaacccttttatcagtatatgatgtcttcatttgtctctagtagcatttttcatctcaaagtctgtctttgagataagcactccagccctctttggttaccatttgcatggtatatctttccccatccttttacttttaacctgtttgcctctttgaatctaaagtatgtcttgtagccaggtgtggtgacacgcacctgtaatcccagctacttgggaggctaaggcacgagaatcgcttgaacctgggaagctgagattgcagtgagtcgagatcatgccactgaactccagcctgggtgacagagcgagactccatctcaaaaaaataaaaataaaataaaaaaataaagtatgtctcttgtagattacatgtagctggcatacaagtgaatcatagttttgttttgttttgtttttgagacagagtcttactctgtcacccaggctggagtgcagtggcgtgatctcggctcactgcaacctccgcctcctgggttcaagcgattctcctgcctcagcctcccgagtagctgggattacaggtgcatgccaccacgcccagctaatttttgtagttttggagagatgaggttttaccatgttggccaggctgatctcgaactcctggcctcaagcgatatgcccacctcggcctcccaaagtgctgggattacaggcatgagccaccacgcccagcttggatcgtggttttttccttttaatctattctatctatctctggttttaagtggagagtttaatctatttacattaatttaattactgataaagtttacatctgccattttgcttttttttcctatatgtcttacatctttttgttctttctccataactgccttcttttgtgccacgtattttctagtgtaccattttaattcccttatcatttcttttttttttttcttttcttttttttttagagacaaggtctcactctgtcacccaagctggagcgcagtgctgtgatcatagctcactgcagcctcaaactcctgggctcaagcaatcctcccacctcagcctcctgagtggttgggacaacaggtgcacgtcaccacactcagctacttttttattttttaatttttgtagagatagggtcttgctatgttgcccaggctggtcttgaactcctggcctcaggcaattctcccaccttggcctcccaaagtgctgggatttcaggcgtgagccaccacactcaacttaagctattgatcttattgatgatcctgtgtatgtgatgagtcatttttctcttgctgctttcaagagtctctgtcttcagctttgattatgatgtttctaggtatggatatctttgagtttatcccacttggaattcattgagtttcttggatgtgtagattatttttttaaaaatcaaatatggaatatttacaaccattatttattcaaatattctttcctaccctttctctctctcctctccttctgtgacttccattatgtgtatgttggcatgcttgatggtgtcccataggtctttagactctgtttttctttgttctcttttctttctattcctcagactacataatctcaattgacccatcttcacgttcagtgattcttctgcctgctcaaatatgccatcctgtagcttctctgctatatttttattttggttaatgactccagaatttctattttgttctttcttttaaaaataatttctgtctcatttggatgtggtggctcgtgcctggaaacctagcactttgggaggctgaggtgggtggattacctgaactcaggagttcaagaccagcatgggcaacatggtcaaaccccatctctacttaaaaaaaaaaaaaaaaaaatcagccaggtgaggtggagtgcacctgcaatctcagctacttgggaggctgaggcaagagaattgcttgaacccaggaggcagaggttgcagtaagttgagattgtgccactgcactccaggctgggcaacaaagcgaaactctgtcttcaaaaataataatgataatgatttttgtctatttgtatcttttatttggtgagagatcatctcatgcttttctttagttcttttgatgtgacttcctttagttctttgaacatgtttagcatagctgatgtgaggcctttgtctagttagtccaatatctgggcttcttggggacaatctctatttattgcttttttattcctgtgtttgggccatacatttgtatttcttggcatgtcttataattttttttttattaaaaactatactttttgtatgatttaatgtggcaactttgcaaatcagattgacatacctcccagagtttgtgttgttgctgtttgttgtagttgttctttgtttcattaatacattttcttagctagttctggaaagtctgtattccctgtcacgtgtgaccacttatagtctctgcttagcttagtgattagttaatgattgaacaaagatttccttaagcatttgtcaccaaaaaatctccccttctctgctaaggggctctgtgtgcgtgtgtgagcatgcctttacactcagccaggcagttgtcaactctgccttagtgtctgtgcagagatgaggtcagccagagagtttagggctttatcggttttcctgagcatgacacagctctgggcgtgcacacagctctatccatgcttgtgaccttctagactcccaggaatatgtcagatcttttcaaagccctgtggacacatcatgcttcagcttttccttttacttatttacttttgttgtttaaatgtaatagaagttgagcacagtggctcacgtctgtaatcctaacactttgagaagctgaggcgggaggatcgcctgcattcaggagtttgaaactagcctgtgcagcatagtgagatcttgcctttaaagagagagagagagagagagaggagagagagagaggagagagagaggaagggggaaggagggagggagggagagagagagagagagagaaagaaagaaaatagggacagggtcttgctatgttgaccaggttggttgtgaactcctggcctcaagcagtcctgcctcagcctcccaaagtacaggcgtgagccactgtactcggcccagcttttccttttaagcttttcggtaggtctattcctttccccacctgttatccactgcctcaggaagctgcaaagttagtcagttgcctgcaattacaccctgatgaaaagacttttcacaccaggcaaaggctgaaccaagtcaattacagccaaccttgcaagaggagccttatcagggaaccaccagaccggtcagataatgacagttctttgggcatgagacttgaaaggagctccagcctcattctgctccctcttgtggcgccaggctgctgtttttcatcaggagtgcagaatgtgaattttcaaggccaccacggaactgcagagtgtgcgatcttaactagggcaagtgaaaatgccactgttcttaccaagattctgctgtttttcttgaataaacattctcccgactgccctaagcctctggctaatttccagagttctgaaaaagttgattctgaccatttttgccagttttctcactgctattatggaggagagaatttttggaggtccttacttcacggattttgctgatggcacacctggaaaactgatttttgtttgtttgtttctttgagacagagtctcgctgtgtcacctaggctggagtgcaatgtcacgatcttggctcactgcaagctccgcctcccaggttcatgccattctcctgcctcagcctcccgagtagctgggactacaggtgcccgccaccacgcccagctaatgttttgtattttttttttttagtagagacggggtttcactgtgttagccaggatggtcttgatctcttgacctcgtgatctgcctgcctcggcctcccaaagtgctgggattacaggcatgagccaccgtgcccagactttttttttttttttttgagacagggtcttgctctgtcacccaggctggagtacagtggtgtgatctcagctcactgccacctccgcctcctgggttcaagcgatcctcctgcctcagcctccccagaggctggtgcatgccaccacgcctggctaatttttgtatttttaatagaaacagagttttgtcatgttggccaggctgttctcaaactcctggcctcaagtgatccacccaccttgacctcccaaagtgctgggattacaggcgtgagccaccaagcccagcccaaactgcttttttttttttttaatctccagtgagatcagaagtcacctgcctgggttggctctgaatgtccctacctgctctgttcccctgaacctggagtcgccagacacccaacccatgactacacccaggccagtcttgaccctgggcgtaaaaagcattccccactcctctctgctctgtatgttcttatacttttgctgcttcttcgggagtgggagccaggatggctgagaaactcctcctctgaagctgtctgtagtcagctgcttcctaaggccccgatctccctctcagacctgctgcctcctgcccaggggagctttcagattatggaatagacccgggctcccataaacgtccctgccaaactatctgggtgccagagctctaaaagactgaggcagagccactttgccatgattaattcaagagccttgactcagtcattattcataacctctttcagtggtttttcatgccagctcataccagcccagactctggtgctccgctgctccaagaagggcccctctagggccatgtgggacccagtgggacctactcttgagcactgctttgccaaagtagaacaggcttatcttttatttttatttatttttattttttgttttgtttttgagacagccttgctttgttgcccaggctggagtgcaatggcatgatctcagctcactgcaacatctgcctcccaggtgcgagtgattctcatgcctcagcctcctgagaagctgggattacaggtgcctgccaccacgcccagctaatttttttgtgtttttagtaaagatggggtttcatcatgttggccaggctggtcttgaactcctgaccacaagtgatccacctgcctcagcctcccaaagtgctgggattacaggtgtgagccaccaggcctggcctatttttattttttgagacagggtcttgctctgtcacccaggctggggtgtagtggcacgatcatggctcactgcagcctcaacctcccaggctcaagcaattctcccacctcagcctcccgagtagcaggcagcctcccgagtaacagcctcccgagtagcatgtgccaccatgcccagctaggttttaaattttttgtagagacggggtctcactatgttgcccaagctgctcttggattcctgggctcaagcaatccttttgcctcggcctcctaatgcgctaggattacaagcatgagccactgtgcttggctgagcaggcgtatctaagaaaacatatttctgggccagctgagttcagggaaaatgccttgaacttggagaaatactaagtcaaagcttacgagctaagtacttttgttattttacaaaacggcctttcctagaaacagctctgagtgacagggtgagccctcattgtgcattcatgggaaaatggaaacgaaatctaacaggacaaaggacagataacctttccatctttcttggcaaagcactaataacagatcacagtaaaggctaaagctcctctgtgagtttctttccaacagaggcagcagaggtacaaaggataagaggaaatgggctaatgtagcagagagattcacctaaatggagtctttccacgtgcttttccctacgttagggactcggctctcctctcgcctggctccctccatcctgaggctcatcttccatctcagctacctgtcacttcctccaggaggccttccctgaccaccctcatgtgttcccctgccactatgcctgtcctatccccagaggcttgcccagggccaagtgttgggtagggagtcaatgcctgggaggggctcaaggaactgaatgaagcttgcactctgggagtctctccagagagtctgtagaggctggtaggaaactcaggctgatttgaaccaagccctgattctagaaaaccacatacctgccaaaccagaagcagcagccccctctctcccctgctccctgccctaaggaaggaagcctgtgcccccttccactccttcttcatctccttcctcaccagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtacccaccagccagacactggagagaggagggaagggaggggcagtaactgttccctggttccccatcagaacccctggggacatttcctttaacacattttattttgagatggagtttcactcttgttgcccaggctggagtgcaatggcacgatcttggttcactgcaacctctgcctcccgggttcaagcaattctcctgcctcagcctcccaagtagctgggattacaggcgcctgccactatgcctggttaattttttatttttagtagagatggtgcttcactatgttggccaggctggtctcgaactctgacctcaggtgatccacccgccttggcctcccaaagtggtgggattacaggcatgagccactgcgcccagcctaacactttatttttaagttgagtagtgataatacatgcccacggaacagaatctaaagggtgcaaaaaagaaaatgccttcctctcacctctgcctgcacctcctcccctccctccctctcttatgtctgccttcagagctagtctctgcgtatgcaaggaaacacacctctctcttctttactctttctttttgcacacttcacacactattctgtactcgatgttttccattgtgtgtaccttggagatagtttcatatttcatacaccgctgccccatgcctattaataactgcatcatgtgggtgtaccataatttatatatggattctaatattttgttgctaccccccaaaaaatacagcaaagagcatctttatacacagattgttgcacacatgcggggatatatctacagcagacattgctggcagtgggacttctaggtcggagcacacatgcatttttaacattgccggatattgccttattgtggggagtcttggcatataccgattcttggccttgcacctggaggttttgattcagtaggtcgagggcgaggcctcagcatctgggttgtatgaagcttgccggcgactctgatgatcagccaggtgtgggaactgtggacagaacagcaatcctcaaagtgtatttgctcccacgaattgccgggagctccatcctttgtggcccagtggctgaccccaggacggtggggtgagggcggagaaggcaaaagccaggggaaatacagggcctcgaagtctcactgtcgcccctcctcccaccaggtcatgtggtgggacatccgaaagatgagcgagcccactgaagttgtgatcttggacatcaccaagaaggaacagttggaaaatgccttgggggccatctccctggagttcgaatctactttggtgagtgtcccttgctgtcccttccccgacttgcattgacagggcagccagggctaaagacaggccattgctaggatatcaggtgctcgtggaacccagcaccagcccagggaggccaccctcactgcagccatcctagacgtgtgtggcctttacaacaactttccagcagggggcagcagagcttctcgaagaaggacaccatagtcatcatggcaccaagtcatcttttggccagtggcccagctgaacacagagggcaatcttttgacagaacaattccagaaaagccctgttttgtggggaaggtcacgcccaggaccaacatcgggaggcctggactccaacccaggtcctggccctgcctggcacggggtccctaggctggtcacctgccttcctctggggaaggaagaggtactggagaggaaaatgaggtcaaagcaggctccttggaaaaccagagcacaagcatggtctcggtgttcagtcactgagaatgacaaagaaatatcaaagttcaggtcgggcagggtggctcacgcctgtaatcccagcactttgggaggccaagaatttaagaccagcctgggtacataatgagaccccccccaccgcccgcccagtctttaccaagaaagaaagaaagaaagagagggagagagagggaaagaaaaggaaagaaggaaggaaagaaggaaggaaggaaggaaggaaggaaggaaggaaggaaggaaggaaagaaggaaggaaggaaggaaggaaggaaggaaggaaggaaggaaggaaggaaggaaagaaggaaggaaggaaggaaggaaggaaggaaggaaggaaggaaggaaagaaggaaggaaagaaggaaggaaggaaggaaggaaggaaggaaggaaggaaggaaagaaggaaggaaggaaggaaggaaggaaggaaggaaggaaggaaggaaggaaagaaaaagaagaaaaatatcaatgtgaggcaaggcgccgtggctcacacctgtaatcccagcactttgggaggctgaggtggcaggatcacttgagcccagcagttcaagaccagcctggacaacatagcaagacactgtccctacataagaaaagaaaaaaagggccaggcacggtggctcacacctgtaatcccagcactttgggaggccaaggcgggcggatcacctgaggttgggagttcgaggccagcctgaccaatatggagaaaccccatctctactaaaaatacaaaattagctgggcgtggaggcgcacgcctgtaatcccagctactcgggaggctgaggcaggagaattgcttgaacctgggaggcgggggttgcggtgagccaagatcgcatcattgcactccagcctggacgacaagagcgaaactccatctcaaaaaaaaaacaaagaaaagaaaaacaggaaatatcagtttgagcatagtgcaaatgtgttagaggagggaagcttcctagaagcagtaaaggaagacttcctcgctagagtaagaagacaactttcccttgttgttggcttttggtttgggctgagtcttggtttacgtcttagtgcagcccaggcctggttcccccttgggggtgtcacttgtttgcttcggggtcatgggccatcattcctagggctttgggaggccctggcctcgaacatacctgggcaaccctagctcaaggctgagagatgaatgttgatggaaggaggagacaattccactgaccccctccccagaggacaaggcactgggcagggaggttggggtggcgagggctcaggaaaacattctgtcccagaggcaaggctttctaggccaagtgctagacatgcagccacatcactactagggccatctcctccatgcctggcccttgcagggtgcacactgtgtgttggacacttgtggctgcctgatttaataagcttgtgcagtcgcctacaaccatctcgtggggtaatgttattatccgtacttgccagacacacacgatgagtcttcatgagattaggttgtgagtcctagtacctggtaaagctgggactcaaacccagggctccaactctgaggcccagagtgtccacctgcagcccaccatgaagtctgaggctagaggcacgatgggccactcagatctgggtggcctttctctctggctcactgacgggcggcgtgcagtcggcttgaatactttcttctctggacctctcaagcttggtctttccacttgcccttgacgcccaacttgaagcccaggtttttgttttgttttgttgagacatcgttttgctctgttgcccatgctggagtgcagttgtgtaatctcagcttactgcaacatccacctcctgggctcaagcctcagcctcttgagcagctgggaccacaggcacatgccaccaagccaggctgattttttttttttttttgagacagagtctcactcttgcccaggctggagtgcagtgacatgatcttggctcgctgcaacctctgcctcccaggttcaagtgattctcgtgcctcaaccaccacacctggccatgttctgggtattttctagagattttatatttatcattttagtaattttctggtagaagaaaactgcataataaaacaatatgttttttaaaaaaataaaaataaaaaagctggggggccaggtgcagtggctcaggtctgtaatcccagcactttgggaagccgatgtgtgcagatcacttgagcttaggagtttgagaccagtctggacaacatagggagactccatctctacaaaaatacaaaaattagctgaccctggtggtgtgtgcttgtggtccctacgtgggaggctgaggtgggagtactgcttgagcccagaaggtcaaggatgcagtgagctgagatcgcactgctgcactccagcctgggcaatggagccagaacctgtctcgagaaataaataaataaactaggagttcttttttcttttcttttcttttttctttttcttttttcttttttttttttttttttttttttttgaggtagggccttgctctgtaggccaggctggagtgcagtggcatgatctcggctcactgcaacctctgcctaaaacctgggagttctataggggcaggttcaccagctgcagaggacatctgagcccgttgacaaaggccctcccctcagtgtgcccctcccctacctcactcagctgttctttccatttggaatgctgaggacacagcaccattgtaggctcaggccctgctggtggaggttgttcagtctagcccagaagttaagacagaacagtaaacaaggaagggcattgcgtgatggagggggtcatgctcagagacgcgaggggagcactggaccaggagtcaggagaccagcctttgtgcattcagtccgcagtgaagtgaataactactaaagctcagttcgtgggcgatggacccatgtcagacaagctcgtgcccctcaaagagctcacccaccagtggtagggggacgagttacatcaccgactgccaggtaacttcctgagtgctggttggtcacctgctctgagttctcagggacaccagcctggacaatgctatgacaaatgtcactgtcttgccagggaaggctctgcccatcccatgagtgatctgggtgggccaccctgcatcccctccctgggtcttctttactctctctgtaaacaaacattcaggatctttatggccaaatgcatcgaggacacagtggtgctctgcagagggggctagtgacctgacaaccctccaggactggaggagccagggagggcttcattcagcacaggctccttgagcagcttccaaaaagatggggtctgaggagcccgggaagagtggggactgctctccaggaggggccacagcccttgccaaggcttgatctgagggcctttctagcgcctgcagaccccccaagcaagctcctgtccatgcccgctaatcccagaattgatggttcgtggagtcttcccctcctgtgtcactccttccacagcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaagaggcgatgctggggacaggaggggatgcaggagacaggaggggatggagggagcccagctgggccccggagagtcccgagcctccatatgtaaaatggagaaaaacctttccacaaacacccgagctcgtgttagcaagtgacttgctccagccactccacaaagtgataagcttcaaacactcagttactaaaaataatggccatggcttaattttatttccttttttttttttttttttttttgagacagtctcgcttagttccccagactgagtgcagtggcgtgatctcggctcactgcagcctccacctcccaggttcaagagactctcctgcctcagcctcctgagtagctgggactacaagcacctgccaccatgcccaactaatttttgtatttttagtagagatgggattttgccacgttggccaggctggtcttgaactcctgacctcaggtgatctgcccacctcggcctcccaaagcgttgggattacaggtgtgagccaccgcgtctggctggcttaattttcataatcctcaaactatccccaggaggaggcagcattgctcttctcttcatctcatttttcatgttagggaactgggctacagaaaggccaagccacttgctcctgctctcccagctagtgaggagccgagattgggtgtgaaccaaggaagcttggctgggaaatgcgggtgccttggcacaattcagcagtgaggcatagcctgtcttgctcagtgccactcctctgaggagagcaacagacagggagcttgagacagagctatgagcacaatggttagaccagagaagcttagactatcacatccccctccattcttcttagggcccatttaccttgtctaaaagtgccctttctcctcctccccttcatctcctaaattaggtaataagcccgaattctaaccacccccttgagtcattcaccaccgagcactgccatgtgtattgtgcattgcatgtataaataattacttttttctcttgctaaaaaaaacatcctggggttcctttcctgcccacagaaccacagactcctgcaacgtcaaagccaccagcaaccctaatgagcatctttggttccagtgcttcccaaatctggttgcatcagaatatcttgggaggagtttttgtttgtttgttaaaatgcttttgagatggagtcttactctgtcacccaggctgaagtgcaatggcgagatctcggctcactgcaacctccacctcccgagttcatgcgattctcctgccttatcctcctgagtagctgggattacaggcgcacgccagcacacccagctaatttttgtatttttagtatagacagagtttccccatgttggccaggctggtctcaaactcctgacctcaggtgattcgcctgcctcagcctcccgaagggctgggattacaggcatgagccaccgtgcctggtggaggagtgatttttttaaaatccagattctcagccccaaccctgggggtactaacatagaatcttgggcttagcccaggaatgggtttgctaaggagcaaccccaggcttgtgactcagccagtccttgctttgggagcagaaacctggttcgatgtcctcattctacaggggtgggaacgctggctgacaagggcagtgcattgttccaggcctcatagcaagtagggggttcccagtagatgtgaagccctttacaggctttaggagccttcccaatgtcttcaggtcctgcaggctgccagggctgtgtgaaaggagcagggtgtcgagcacagcacccataggcctttcgcagggctggttcctagagggacttggtggacctgtgtcgtagaacctgggtctcccttgtcctcctcctgcataaggttaaacaaatttagcaaataagaatatttgaccctgggccaggtgcagtgggctaatgcctgtaatcccagcactttgggaggctgaggcgggaggatcacttgaggtcaggagttcaagacgagcctggccaatatggtgaatccccatctctaataaaaatacaaaaaatcagctgggcttggtggctaacgcctgtaatcccagcactttgggaggccgaggcgggtggatcacctgagatcaggagttcaagaccagccgagattgcgccactgcactccagcctgggcgacagagtgagactccgtctcaaaaaaaaataatatttggcacttagttaaatctgaattttaaaaaaaaaaactattttttttttagtataagtatgtcccatgcaatatttggtatatacttatactaaaaattattcattgtccaaaaatctccagatgtttctttttttggggggatgaagtctctttgttgcccaggctggagtgcagtggcacgatcttggctcactacaaccttcacctcctgggttcaagcaattcttctgcctcagcctcctgagtagctgggattacaggcgcccaccaacacccctggataatttttttatttttagtagaggcagggttctgccatgttggccaggctgatctcaaactcctgacctcaggtgatccaccattctcggcctcccaaagtcctgggatgacaggcatgagccaccgcgcccggcccagatcctttctttagtcttgatcatttctcccactgtggtctggctgtcaacacactaggtttgcaaaggtgactgggaagtgtagtctgccttgctcaccaggggcccagctacaactatattgcaatggaggaagggagaggaggtctgggtgaaaatctgaaggctgcactgtgtgtgtgtcccttttaaaaaaatgttccgtcttcactgaagaaactcttgaaaacccagatgaaaccaagtaggaagtgacactctccttatctcagcggtagcagcttttctgggcatgtccttcctctgactcccatccgtgagtcccagggctgggaccaggtccagcaacacgtgcctgctgcctggagttagcagcagagaaatgccagtggccagcccacgggaaggactgtgcccagagccctttctttattttatttgagacagggtctcactacgttgcccaggctggagtacagtggcacaaacatggctcactgcagcctcgacctcctgggctcaagcgatcctcccatctcagcctcccgaggagctgggaccacaggtgctcaccaccacacccggctaatttttttattttttgtagaaacagggtctttccatgttgtccaggctggtctcaaaatcctggcttcaagcgatcttcctgccttggcctcccaaagtgctgggattacaggcacatgaccagcccagagccctttaaagaacagcctgtcagacacctgaggtcaagagtttgagagcagcctggccaacatggtgaaaccccatctctagcaaaaataaaatattagctgggtgtggtgacgggcgccagtaatcccagttactcgggaggctgagacaggagaattgcttgaacccaggaggcagagattgcagtgagccgacatcgtaccactgcactccagcctgggcaacagagcaagagtgtctcaaaaaaaaaaaaaaaaaaagcaacctgtgagctgtggatgagtgaggtcagcacagctagaagtcagacacaaggaagaacttcctacctagcaagactctgagatcctggagcccagaagggaccaagtgagccaagctgtggctcagaagcctctgtccctccaaccatgatgtggtctacctcccacaggtaccacatggcttacctcactgatgctgcctggagccccgtgaggccgaccgttttctttaccaccaggatggacggaaccctggatatctgggacttcatgttcgagcagtgcgatcccaccctcagcttgaaggtcacgcgcatgtccctccttgtgcatccaggtcctcagggagccaggtcccggcgtgggtgtgagtgtggggtgctgtgagcacgtgtgcagtgtgtggccaggtgtgtttgggcctctgtgggggagccgtgtgcaggctgactgcagcgattgcttttgagcgtgtgctcctacaaaggttaaggggcctgggggatttggcatcctggtagcacaacagaaccacctgggggaaatttaaaaagaaacaaaagcaggtacccggcatctcctacccacaggccgattccttcagagcccctggggtttggctgctggaccttccccttcatgtcagggtggccagagctgagccccactggctggggccacggaagggtgggggcattggggaaccacagggtgactgtgaggcggaactgaaggggtggggcgggagatgaggcagggaagccaggagccttgacaaccagtctccgagtttgaacttcatcctgtgggcagaggcgtcctgaggatgtttgaatagggccaagtggctgagcctccccaggggccagttaatcagacacacataactttgctcctctctcctctacctgggtctgcccggccccttcaataggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccgtaagcaccgggtgcctggggaaaatccctccagcacgtcccgacctggccccacagcagagcaggctagtcagacaaatagatggccccgccctcccacccccagaacataggtgcacattttgggggaagcagtgtgggctccataaataggtgttggtgtgtccatttgcctttgctcaactgctgggtagctaagtggccttcagtaagtcacgtcactctccaggattcagttttttacctgtaaatcaaagaggttcgacttggtcagtttgtctagtttcaaataacacttttttttttttgtggaaactttccaatgaaggcttagtattgtattatattatattgtattttaatttaattatttttatttatttatttatttttgagacaaagtcacgctctgttgcccaggctggagtgcaatggtgagatctaggctcactgcaatctctgcttcccaggttcaagtgattctcctgcctcagcctcctgagtacctgggattacaagtgcataccaccacgcccagctaatttttgtatttttaatagagacaggatctcaccatactggccaggctggtcttgaactcttgaccttaagatgatctgcccaccctggcctccgaaagtgctgggattataggcgtgagccaccgtgcccagcctaattattttatttatttttattttatcagtttattttattttacttcattttgagacagggtcttgctttgttgcccaggctggagtgcagtggcacaatcatggcccactgcagcctctacctcccaggctgaatcggtcctcccacctcagcctcctgagttgctgggaccacaggcatgcaccaccatgcctggctcattttttaatttttgtagagacagggtctccttatgttgcccaggctggtctgaaactccagggctcaagcaatccttccacctcagcctcccaaactgctgggattataggcatgagccaccacgcccagcctgaagacttagtagaatgctaatagggaagccagatagaaggggacttgaagagggggactgagatccattcctacatcctttccccagtggacagccctgcaggcaaccccccagaaccatggggaacactgtggaactgaaaacccctagtgctagggccgggtgtggtggctcacgcctgtaatcccagcactttgggaggccgaggcgggcagatcacctgaggtcgggagttcgagaccagcctgaccaacatgaagaaacctcgtctctactaaaaatagaaaattagccaggcatggcgtcacatgcctgtaatcccagctccttgagaggctgaggcaggagaattgcttgaacgtgggaagcagaggttgtggtgagccgagatcgtgccattgcattccagcctgggcaacaagagtgaaactctgtctcaaaaacaaaacaaaacaaaaaaggaaaacccctagtgctgaggcctggagagcctcctggctctgcctgagactgggatctcaccattgagctggtccttgttgggccaaagccgccatatttcatagctccaaagggcgctcttctgcctgtggttctggaactccatgctccttggcattgagtaactcagtgtccctgctgcagccttccaaccccaatattcagccctccttccttgacaccagccctgggtacagacctctacagtacagggactgtatggagagcaaggagagctcagcagaagccccacctggccccagcactggagtcgcttgccatcctgccctctccccaccgggctctctctgtccctgggtgcccagatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctgtaggggcctggacaggggttgggtgggttggggactgggcgggacacatggcacttgggttctgcttctgcttgccgacttcctgggtgaccttgagcaagtagtcttacctgctagatcttaatttattcacctggcaagtgggaagaattattcccttccttccaaagcatcccaagtctccaaacagacttcaggctccttacaggcaggaaccatactccatgcctcctggtatcctcccctccccccagagagggcacatggtgaaaatgcgtgttgagtgactgaacgagggaacatgtgtgttgagtgactgaacgagggtcctagaggtaagtgagctgtcagagaggaatgggccttgagacccctggagggaagggctgggacattagcggtgtgcacgtcatgctggcttacccaggtttggtgtcaggagtgtgacctgtggtcagctcatctgcccatggccccagctctaaagcactttctagctgtatcacctgagctggtcgcttcacttctggcttccttcatttccatctggaaaatgaggagatgttgctataaagatggtgtctggtcatcttccaggccctcttttgtaccagcggagagaggaagaaaagacattgcctgtctgggtcacctccttcaggccccacagataagatgccaagatatgaaagagccaaagagcagcgtggaagggaaaagaaacagcgggtatatgccaggatttacccttgtaggcaagactggctgcagacttggggattgcaggcactgcaaaatgaaaatgtgagggccctcgtttaaaaagtattaataattttaaaacagtgacaatagagcgttaaaccaagcgtgggccctgctgagacagggtccagtgtatctgcacagagcacccacccatgacgcctgcttgaagaagagctgtatggcaagttcttggtccctgatagagtggacagagcgaaggatggtgcatgagcacacagggaagataactggttccatcttgtgatttcttccctcttctgcctccctccccctgggtctaaagctgtgatttccacaggtgcattttgcatttgggggtacttggttatgagatgttttcttctcacactgggtaatacaggtggggcagagagctccctccacttctggtggaggcaaaactagaatcctggattctgacgcctaatccagggctcctcccactcaccactcctggcctatccagccctgcagaaggcaaagatgacactggccaccttttacaacgcaatggtggctggtaggcaccatgctttgtgacatatgtcccaaaacgtgctcctcaccatggcttgaacattctacatgaagaagttgagccttggaaggggttcaggttcacagaacttggccccttcctcctcctgcctgccacacacttcctgtctctctcttagtctgcaattggcccaaaacgctggtggtcacaaagtaccgcgtggtactgaagctgttttacataggctgggtccttatgcccactatttctaatcctggccacagccctgcaaggtgtcctgtcctctctatgggtgagggggccaaggagactcaggaggagctagcccgaggcctcccagtctgcatgtggcagaagccaggcgtgaacccaagtctgccagattcccccagctctgcccactttccgcactgtctgggccctcaccagccgcagagctggcacccgggttccagggtgctcagcgacccaggcttcagccatttggctgctttggtcctcgtggggttcacatcccaggggagtggggaaggcctgtcccctaccaacaccaacacttctgtgctgtcttcccctgcagcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttggtattgccccgctctcacaagtgggaggctgagctccgccttaaagcagcactgggtggtgggctgggagcatcgggccctgactccccagcccctacaaatcactagcccccactgactcactgggcactgagtcctgagccaccccttggagagagggaaggggcggggcttgtcccggagctggctgccccattgtctcagccaccctgagcccaccccaaggccgaggccaccttagtcctagtcctggatgtctcctgggattcagcttctcacaggctccccagcaatcattttcgtttgtaaccttgcagaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcca

SEQ ID NO: 363 - DNA, 40638 bp, Homo sapiens; identical to SEQ ID NO: 362
  source 1..40638: mol_type = genomic DNA

SEQ ID NO: 364 - DNA, 29609 bp, Homo sapiens
  source 1..29609: mol_type = genomic DNA
gcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccccgctccgtggtctacttcagtcggcctccagcgacagagtcctgtcccctcgccgccaccccactgagaggacaggcaacgaccagggccgggactcttcagagcaactttccccaagtcctgcaggatgggtgtcaagaagggaccatggcctttttagactttcctgagcctgaaaattaccccaacttcaaccccacccccacctttccaccctcccattgggagatcccgcccccaaagcgtgcgcagatgaatctcggctctctcatccagaaacgccaggggcagggagggcttgacctaactgcccccagaaggagggtggcggtttcccagttaatcagaggctgctccagccctggtgaggtcaggagtttaaagggatgtgggggtcaccagtaggaagacaagggcccctggtgtcaggatggggcccggagtgcctggttcttgggctgcaacacggatgctgcccaagtccggattcgaagtagttcagagaagtgctagatgcagctaccatggccccacagagccctggggcctgggacagatggggaggtgagagtgggggctgtggaggggaaggtggaattcctgatcatcagtggtgcctgggccagagcaacaagggagatgactcagtgacctcgaggccaccactaggctgtgggtgggtgggtgtctctctcagcaagccccttcctcatcccctaatttttgaggtctggggaagggccctcatcaccagaaggtgggcagtaaggtaactggaggataatgttgctcccagagtcccctacctctcaagggtgggcttgcttctctgaaaggagcctcagctccagcccccaagcaagccctgggctctaggacatcctctctggctttttagaatgtgtctctttgaaaatcactggccttggcatgtattgtgtgccccggggagcagggatgaagggtcctcccctcccgccagtggaatttggctgaagatgccactaaaggtgacccgtcaggtagtgtagttccctctgaaagtgccttttgttttgttttgttttgtttttcttttttgagacggagtttcactttctcacccaggctggagtgaagtggtgcgatctcagctcactgcccctcaagttcaagcgattctcctgcttcagcctcccgagtagctgggataacaggcatgcaccaccacgcccagctaatttttgtatttttagtagagacggtgtttcgccgtgttggccaggctggtctcgaactcctgacctcaggatccgcccacctcggcctcctaaagtgctgggattacaggcgtgagccaccacgccaggcctgaaggagtcttcactcggccagagggccgttcattctatccccacacccagcagctgttgccctttgatcagcacaagacgtgctccccactccaccctgttctttagggagatccacgcacaggatgagacccatttcacactggctggaggacaggcagatgggggtgggcgctctaggtgacactctcctcggtgtaggaatgtggtcacaggctgttgggatgatgggggacattccctgctccatcccacctaccaggcctcatcccagagccgtgcctgcaccttcctctgcagcacgtcattcgcggaaacacagagaggctgctccagtgccagggccccaagttcaagcccaggggagctgcgagtgttttatttgggcgtgaggctgaggcaggctggaggagcagacagctctctcccctggggctctcccggaggccagggctcctggggagactcatcaactcagacacagtccaacactctgtggacctgctgccctctgacctaggtagagttttacttaggacaagggaggcctgagatggctgaatgctagagaagccaggggcttgcttgaggtctctctgaggcccagcatggtcctctccctctaatcccaggggcttggttttccctcccaggtggcgcttcgggtccggcccatcagcgtggcagagctggaggaaggagctaccctcatcgcccataaagtggatgagcaggtatgcagggctctgcagcaggagctgcagggcagaggtctgctcagatggctcagctcacctggtgagggcagaaagggcccctgtggcttgcagcaccctccttcctctactcactgaactcttggctgtgctgttgatgacatcaccaaggaagctgggggctcttcttccaggaagccttcctagattgatccaaggacaactgggagcttccctagcctgggtgggccctgatcctttacctttcacatgctcattgcttgactttcccaccctaatatgcctgctgcccacagagcacatatatatatggttgagagctaaagctcgcctctagggtgtaacgtgtggcaaaatcctcgctctctgtttgcaatcttggtcctcatgtcaccaggatgaggaaggcagggcacacgaggcaataagtgtgtatcaagtaccagcagcatgctgggtactgttctagaaactgggaaactgtggtgaacagaaaaggccctgtcctctctccattaccttaagtctagtgtgaagagatgaggcattcatcaaagaattgcatcacaaacaaacgagtttgcagctaacaagggcttcaaagaaatgcttagtggcatgagagtaggtaagaaggggataagacctaaacctggaggtcagcgagggcttccttaagaaactgtgcttgacactttgggaggccgaggaggccagatcacgaggtcaagagatcaagaccatcctggccaacatggtgaaacccagtctctactgaaaatacaaaaatttagctgggcgtggtggcacgtgcctgtagtcgcagctactcaggaagctgaggcaggataatcgcttaaacccaggaagtggaggttgcagtgagccgacatcacgccattgcactccagcctgggtgacagagtgggactctgtctcaaaaaaaaagagaaaaagagaaaaaaaaaaaaaaactgtgcttgagctgaaaacataaggggtgaagaagaggtcattagtagcatgcatgaggggagaaatgttgacctgaggggcttgcatgtgcaaagggcctgtggtgagagggactgggatgcaactgggtagctgagaaaaggccagagtggctcaagcaggagagtaaggggcaagaggtgtgaatgggctgggccaaaccacatactctgtagaccatggccaggatgtttgtttgggtaggcagttgaggactcgtgctgggatgtacacaggcacagtggtgggggcaacaggagtgggcttggtgcccaggtaggagcatcgtggtggtaggatgtgctaatggctcagagaagttgggtggcactgtacaatgcagagaaaggcacacgtgagcacctgatgggcctgggctcaggtcccacgggctggactcatgaagccctgggcccaggataagcaaaccagaggcagatggcacacttccaatgcctgtttacctctgggctccccaggggcaggggcccactcaagcctctttcttcagcagtgatgatggaactgtgggcacagtagagccatgggtagcagcatcctcatttctttgcccatattccttcttggaaaagggtgggcttcctcaaagaccttggggaaagcaggggatgactgggaagacctcgtctaaatgggtcagacccagctggagcagaatgaatgcacataaacagtggttcgaggaggttctgccatttgccagctgtgcagcctggggggttgcttccaggagcttcagttgcctcatgtgtaagtggagacagacatcatgatgccttctttagagggtctttgtaggctaatgtacgcacatgcttacccagtccttggcacataggaagagtttcatagatgtcagttatcaacgtctgctagagactgaaattccccagggctgctgggttggctcaggagaggagccatagagttcaggaggagaaacctccttccaggcaaagccactctgtttgtccaacttgtcccgaagacatcaggtcctcggggttgggacaatgctgactctctctctgctactcctggctcctggcctgcgtgggggctgataaatattaactggtgctgatgggaacgctccctgtcaaggggacagcccattgtgtgcccacacacggcaaacactggttcctttctatccctgcgtgtggagcaggaggggctccctctctgggtctggcctaatccagccaagatacgcctccactgcctccacctccaagaaggcctctgagctgggtggttctaacagggctgctcctttgtcagctggaggtgcggagagtcttgtctgggctggcactgaggagagctctccatgcaaactccctgtgggcttctggccctaagctccttctgtccccagtgggttcaaagtttggcttgcaccagggatccagcccagcccttctaacggaggactgtagtttaggagcagccataactgccaggctgggacccttctagtaacaaacactgtccctctgacaaataaatgcctggcaagtaggagacaagatacatgaacccaggaagcaaaatgcacatggacccccccttacccttgtccccgacctgaccagttcccccacctcctgaccttcacctgaccctagtgaccccatagctcgctcacagccctggcccagagggaggcttgggggtccagtcctcgtcagcttctctgatggggccagctggcccgtcaaagctctgtccttcctcctaaggcctggaggcaccatggacaggtgggtgtatttgggagctgagccaggacatgttcgtcctgagtggggagaggtggaccggggacacagtaacccgctgggctgggccaccgtgaggggtcctggggcagctttctttagtctaggcattgttctcctggggacacttcaaatgaaggagattgtggcaacgaggcttggcagaaggggacattcccacaggcggagagtcctctgggacaggaacccagggtgcttggattctggggaagctggagttcggatttggatttttttttttttcttgtgatggagtcttgctctgtcacctaggctggagtacagtggtgcaatcttggctcactgcaacctccgcctcctggattcaagcgattctcctgcctcagcctcccatgtagctgggattacgggcgcgcgccaccgtgcccagctaatttttgtaattttagtagagacagggttttgctatggtggccaggctggtctcgaactcctgacctcaagtgatacacccgcctcagcctcccaaactgttgggattacaggtgtgagccactgtgcccagccggtttggatttttaatggggatagtccagttgccttggaaggccagtgattccaggaccccgttcaattccattagtagtcacaatgccttctttagagggtccctgtggctaacggaggcacagtgcataacacagtgcctggcatgtgtcttcacaggggttaataaatgtgaatgtgtctcaagggctgaaatatgggatggcttcgggtcccagaggtaaacaaaacctggcccttgagccttcctgctccctcttcctgtgtcagagcactcaggacggttcccaaatgaacacctcagtgtgtgtgtgtgtgtgtgtgtgtgtgtgtttgtgtgtgtgtgtgtgtgtgtgtgtgtgtgtgtgttcctggaagtaaggtgggagctccatgtcttagtagctcctggggtgagatcagaccctaacgtgtaaacacaggaagcggggaagtaccaggtgggcctggtttaatttacctctggggccccagaggagccagggacagcctgagaggctggtggggcctcagcgttccaggtgggggaaaaagctacagatcaaacagccgtctcctccaatcccccatccctcccaaagcctgcagcccacagaccctcctcctagctctcccaggctgtttgtctgcaggagttaagtcagctgaccatgtgtatgtcccatcattagcatttacctgctgccacccccctctgctcccggggtgctgtagagccaggtaagggctcccaccaggcctagctgtggggcctaggccaggagggctgggtgagggtgggaaaggaaagaggagcgaaggcagaagggccaccaggggagatctggccggacagcgtgactcctgggatggaaaggagaaatgtaggcaagaggagccctgagctcccgagaacagaggctatacagcctgggacccaggaaccagagcacccaggctctctcagccctgccatgtcctggtcgcatactggtgggcaagttgaaactctccctgggcctctgcttcctcatcagaagacaggagaacaggaaacctgccccacccaccccgagagctgtcgagaggattaaaggagataatgtaagggggagcgcagccacgcaactgggaggctgttgggaaagataaataaagtataaggtgacagatgtcagctgcccgagcccagaagtgctgcgggagcagctgtctttagcccacctgcctgcctgggggcagtgaggtgggaaactccctgcacaccgaccatctggacgcttcttggccctggttccccaaagagctgagctggtggagagtggctaggggagggggtcaggattctttacctctccccgcttagccacctgcctgtgtccccagcccctcccagccccaggcagccactaaagtactatccatctccatattgccccttctggacattgaatgtgaatggaatcatgcagtatgtggtcctaatttttttttttttttttttttgagacacagtctggctgtcacccaggctggagtgccgtggcgctatcttagctcactgcgacctctgcctcccaggttctagtgagtcttctgtctcagtctcccaagtagctgggattacaggtgtgtgccaccatgtctggctaattttgtatttttagtagagacgggtttcctcatgttggccaggctggtctcgaactcctgacttcaagtggtccacccgccttggcctcccaaagtggtgggattacaggtgtaatctttatcaacttcactccttatgatacaacttcattaagtgatacaacttcactccttatgttgtgcataatcctctaggttgcaaggatccttacactcagcatctggatggatacaatccactgtgcctggctggtcctaatatttttgaagttcaagttcattcacattatagctcctatcagaacttcactccttttttttttctttttttttcttttttttttttgagatgggggtctcactttgtcactgccaccttgaattcctgggctcaaaggatcctcccacctcagcctcctgagtagctgggactataggcacatgccacagtgcccagttgatttttttaatttttagtagaggtgtggtctggctatcttgcccaggctggtctcaaacccctgggctcaagcaatcctcctgccttggcctcccaaagtgctgggattgcaggtgtgagccactgtatccagtcacctgaacttcactccttttgctggctgaataatgtttgaggtgtggattcaccgtgttctgtttatcctttcatcagttgatgggtgtgtgggttgttctttttggctcttgtgcataatcctctaggttgcaaggatccttacactcagcatctggatggatacaaggaagggtgcttgttaacctgcagatttatgggcccatttccccacagattctgactgtgcgcgtgtgggaagtgcctgagaatctgcattttataagctccctgggtgactcaggtgaaggtatctgcagaccctttgagagacacagccctagtatattcttggttatacacactccccatcctaagcctccaggtctcagaatcgtatagccaggcaggaatctgaccaggacatcagccaggtgtggctgtgtcctaagcagccagctgggctttggtggctttatgagctcagcagggtcaactttggccttctccatccagcctgaaggctgacaggccccagggacacccttcctgggatcaacgttgcctttattgaggactcccaggatggtatgtttacaactagaaacatggccagcaacaaattctcctttaaagaaacaaacaaacaaacaaacagaaacagaaacagaaacagccttacaaggcctagaatcaggatttgttgtggtttagttttacctgtaagaatgaaggggctgtggcctggctccctgggctgcagataaagccagagccagattatctgctgaggcttcctgagtaggataggggtgttggtataatatgatttctcctctcaaggctacagccatgttggtcctcctgacttccaactgggaaaaacttgaggcccagagaagtgttggagcttcctaaaagtcacacagcaatgtcaaactgagcctcacttgtggcaccccctccctcggagatttttgccactagccttggaggctgtgggaggaatggtctaagtcagtggttctcaaccagggcaattttgcccccaggaacatttggcagtgtcacaaccgggggaagggtgcgactggcatctagtgggtagcggccagggatactgctcaacattctacaatgcacagaactgcccccacagcaaagaatgatccagcccaaaatgtcaacagtgccaagcctgagaaagcctggtccgtgctcaggcatttggaggccagaaagaatcctgttaaaagtgcaaagctgataaatgcagctgcagcctagtagtgtgacatgctttgtgcaaagtatttctcacctagatgcttgggatgagcctggtcccccgatagggacacagcttatggatgagacctcctctccctggcctgaggcccccacttccctacgggatcttgagtttccagcttaaaagactccgactccgtctggaactctggaaaggtcaaaatctgcattgaactaagagcagggctgggagaggaggccgtggaggtggggtctcaagccagagcctctgctgagttgggagcctggagctgcagcagcagatgggcttggagggacagagctctggcttgaagctgcccgcctcccatgtgagcaaagttgccattgaaacctcccagagacaggcacccagtatgagcatgagaatgcattccccgggggggctgtgagagagaatgcccatgctgagcccacctgcttaaggctgggggaggagctggctgaagccccacctggggtgtggcaacactcagctccctatggcaggtgagcctgccttggatgttgtattagtttgcaagctgctgtagcaaagtgccacacactgtgtggcttcaacaacagccacttactgtctcacagtaggtggaagtccacaatcaacatggcagcagggaagggtttgctccaggcctctctccttggctttatgcttatttatttatttatgaaacagaatctcactccctgacccaggctggattgcagtggcataatctccgctcactgcaacctctgcctcctgggttcaagagattctcatgcctcagcctcccaagtagctgggactacaggcgtgtaccaccacacccagctaattcttgtacttttagtagagatgggatttcaccatgttggctaggctgttcttgaactcctgacctcaggtgatcgacctcccaaagttctgggattacaggcgtgagccaccatgcctggctccccttggctttagatgagcatcttctccctgtgtctcttcctagcagcttccctctatgcagacctgtgcccaaatttccccttttcataacgacactcgtcatagtggataaagggctccccctactccaatgtgacctcatccttcctcaactgattacacctgcaacaaccccatttccaaataaggtcacattctaaggcactaggcattagggcttcacaacatgaaatctcggggggacacagttccacctctaacaagcgggtactccccccagccaggcagctgtttgtccactcgtgcccttggagaagcatggtgggcaggctgggttctgagacccacaactctgaatctgcccagctctgcactttgcagtgaggctgtgggtaatttacttaacccaactgattcctcatctccaggcaagtgataataagagtgccctctctttttttatttgtttgtttttgtttttttgagacagagtctcgctctgtcacccaggctggagtgtggtggcacaatcttggctcactgcaacctctgcctctcaggtttaagtgattctcctgcctcagccccccaagtagctgggactacaggcgcgtgccaccatgcccggctagtttttgtatttttagtattttagtagagacggggtttcgccatgttggccaggctggtctcgaactcctgacctcaagtgatctgcccacctcagcctcccaaagtgctgggattacaggcatgagccaccgtgcccggcaagagtgcccactcttaagctgtcagggaaaacacacgccaagcccttggcaccatgcctggcacaatcaccactccctataaacgaaagctttattcagcaaacgtctcttggacatctgctgtgtgccaaccaggggggcctttagagggaggctcagaggatgtacagaagcctcccctagtagggactgcatgtgctcacggggtggggggggtgcctgggtgggtggggcatgcgtgtgctggcctctgtagatgcacacgtcagttctcggatctgtgcagtgaagagccttggcacattgagtggaaggtgaagctccagctctctcttcccgacccagtgtttctcacaagaaaccccagtgatctgagctgagaaccagtgccacagcctgcccatcgcctctttgccttgctcatgtaatagtccgaaattctctctccactccacctctctcattctttaggactcaatgctagtgccacctcttccaggaagtcttcctctaggagtaggattaggtgcctccctgtgctctggcactttccaggttattgacatgatccttgagggtcggaaggcaggaaacctggcctccttttgcactctgtccctgagaccttgctcagcaagcgtgttgacctggcctgagcaccccatgctggtctccctggcagctcagagcacctgtccccacccctctccagctcagctctggctcacctggaggaggggcacaagggctccattgtgtgctagaggggacaggaatagggtgatgctctcgagggtggggcgggggctggagcccggacagatggaacccagacaaagccctctttaagcggggatcgtggcagctgtgctgacagtgtactacaggagcctggttagctaaaggaaccaaatgcccaggacgctgtgaacttggcagtgtctggaggttgtatgaaggtcatgggtgggatgggcattggtgcatgccactcaccctccctagcactgaaggcccccctcccagagggtgctcctcaggccactggtcctccccgtgtccacaggaacaccggcattgggatgagagcgggagcagctggctgggttctggttgcatcccatggggacccataccggggaactcagagccaggttttaccttcagtggggtctgacaccagagcagggctcatgctgcaagctttggggcctgggacaggggccagatcctagaagaggctcactgtgaccacctagcttctggccagctggcagggagcctgagtgagtggcctcattcttttccccgcacaaagcccccggtccatcctatctagagccctctcctgtaactggctgacctgaaatcccatctgattgggaaagacttccacatgaggctgccagggtcaggcctcctcttcccgcttccctcctccactgagaatcccagaaggggccttgccagatacctgatggtcataggttagttttgatgcattgagcacaggtatgaacctatcccaggagtccaggtggtgaaggaagggggtttgacccagggcacacgtagaatgctgagggagtctggtgggagccccagggctgtcatcctcctgggactgggcattctaaatccgcaagctcgatctgggtggacccagagggacccacgaggatctcctggatccatggagcccggctgtgctcacagctctgctgcctgctgccccctcaccagcctctcctcaccccagagcggccacccctcatgccttgtctgttcccaagccctttttgggactgtcaccagccctggctcccctgctgacccaggaagggagcatagcccctgtctctgcttctatggggcacccctatgacagcccaccctcctcagtaccctgcccgctgttaggactcagtttacctccttggacagtatcttatccccggttgagttaggtagggctaatgcacaccctgggtgttggggcttcctggaattacaggaactactgagggacagggcaggaactcccctacctgccccaccccacaaggcccctcgtgggagtaggggtggaagtgtgtgcgtgagaggcagtttagaagggtagccggagcaccagctgggacccagactgccaggccccagtcctggctctgccatttcctagcaacatgactttgtgcctcaacttccccatctgagaagaatcatcgtgatgattcaaattgaagtgctcagtcacaatgatccattgtgattatgtgctgggaggagggggctgcccatgccctacctccctcgccaccttccctcccactgaaagaggggaccgatgagacacccattccctacctccctcgcccccttccctcccactgaaagaggggaccaatgagacacccattccctacctccctcgcccccttccctcccactgaaagaggggacgcatgagatgcccatgctggctgaggctgccgtcatgcactccgttcagcacccacggccccagggagcatgctcccttctcatgaagagcacggtggtggctcattttcccctggctatcacaagccaggaccccagggagcccaggcgtccccaggcgcagagcagcatttagaggcgccagctgcctctcagggggcacctccgcggtgcagtggttgggggtggtgcatgaggacagggactatggtccaaagggacctcaggcaggtgcagggcctgtggaatcccagtgaccttctccacggtgagggtggagttgtgggtctcgacttgatggcagagtcatgggtgcggggaacaggtggccactctcagtctccacccctgccctcttaacagcccgttgaacaaagactgttgagctcttggcacatgcccagcgctgtgcccaagcacattacacgttgttccagggtcttcccagcgctgcaggtggatcatgctgctgtcccatctgacagaggaggagatggaggctcaagcaggttataccaggcccgaccaccaataagaggtcacagggccctcagtgcctaccctgattctcctttgctgcccctgctcctctcatcctaaatcctccaaactcaagccctcccacgcatctttgaatgtctcccgtcatttccatgaatctggcattgtctctatcccctcccataccctagactagggcccccagcaaggacgcagcctccttcctctgcatctctgcatagagctcgggacaaggctgagtacacaccaagtgcacaggggcagaggcaggggcagagtggagcaggccctgagatagttctagaaaatgggcccctcggttacctttggaggaagggaagaacccggccaggacccttctgtgtctcaacacacgtgccagcaggtatgcgcgcgcgtacacacacacacacacactgctgccactcctaccctgcagggaggggagccccagctgggattggcccacccatggcctgtcctggctgccagcccaagcccctctgcctccctttccaccctttccactcccggctcaggctcaaagctgcaaagggccactggagcagttccctcacagccctctcagctgcgagtggagatccccaagcccagcgtgctgacctcatccctcacccagctgcctgtggctctttgctctgtcccaggctctgccctggaggggtgaggcggagcaggcagggctgtagcgaggtggataggagtcagtggactttgaactcagagcctggttggcaccctgggtctccccttgctgatgtgtgacgacctggggggtgtgactcctttggaccctgatttcctcatctgtaaggtgggagtcatagctggccttagcctggggtcatggctggggttaaaagagactgtgtgaggccgggtgtggtggctcatgcctataatcccagcattttgggaggccgaggctggcgggtcacttgaggtcaggagtttgagaccagcctggccaacatggagaaaccccatctctactaaaaatacaggtggcacacgcctgtagtcccaggtacgctggaggctgtggcaggagaatcactgaacccaggaggtggaggttgcagtgagccgagatcacaccactgcactccagcctgggcaacgagcaagactccgtctcaaaaataaataaataaataaaagagactgtatgtgtgggtgcttgcaacaggtcctgacacaaaatgagccctgacagatgctgcccgttcttctgttgcacctctctggcagaggcagcatggggggtgttgaagtgaggggcaggcccccagggtctgggctcgtggtagcctgggcatcacctgtgtgtgctctgctcccctggggctgtactggccttgcagaggcaattgctcgttgtcaggaaggtgtcccctttgggcatccaagggcagatgatggcgagcctgacccgacatgggaaagctgaagaggacaggaatgggctctggctccgagacctacctccagtgggacctgggccctggactccggcctctggcccctcccatctcttgcccacatcctgaggcgacgagggctagattcagagcccagaagggctttgttaactctgatcgacaaaggggttaactttgttaaccttcctgagggttgacctcatcagggcccggggttcccaggtgaccgtgggcctccctctggggaccttgcagatggtggttctcatggacccaatggaggatcccgacgacatcctgcgggcgcatcgctcccgggagaagtcctacctgttcgacgtggcctttgacttcaccgccacccaggtgagggagggcctgggctggagacacgcaggagcccctcccccacccttagccccactcaggaggggccctccagggcccctgcctttgaacctcagcctccactccacctgctcaccctctgttccttgagccttccccattcaggaaggttctcatgcacacaaggcacacacacccggcctcctgcaaggatgcactggggttggcactcagacaccaccctacacggtacaactcgcttggctcctactgagctggaaaaggagcttgaaggccatctggtgtggggaggacaggggcagagggtgggttcagcgaagctgacaccctcctcgaggacccccatctcgcccatctgtgggatgctcccaggaacagatgtgatgcatcctcagggcggggggccaggagccagctgcgcaggaaggcgtctcaggtgtcctgggctctctttcagcctgacgtcccccactgtgagtgtaagcagagacatcccctcccccaccccccacccccacttatcttggggctggggctccagggacagaaacctctcctatcagaggtcaggaagagccagtgggtgcctgtgctgtgccccgcctgtgtcccggcccctgacaggcttccttcctcgcaggagatggtgtatcaggccaccaccaagagcctcatcgagggcgtcatctcaggctacaatgccactgtctttgcctatggccccacaggtaaggggaatgcccagactgtgggcgaggaccgcaatgcccctgtaatccccgtcaccctccaactagtctgaccccagctggagcaggaatccaggatgtggtcgctccacatctcacccagggccctccagccccagaggccccaacccgagccggggcatcatcctccccactccccaccacctccctggccctctgagagggcccagccttgaggacaaaccccggtttccaggagtgcctgcccagcaaggcctccctcccagccccaccccggtcaccctccaccttgttctgccccaggctgtgggaaaacctacaccatgctgggcacagaccaggagcctggcatctatgttcagaccctcaacgacctcttccgtgccatcgaggagaccagcaatgacatggagtatgaggtctccatgtcctacctggaggtgagtcccccagcctaggctcagatggggctggcctccctccctggggctggtcactgtgcagcttcccggggcgctcatcactgctgccctcctgcatgcctactgtgagctccactttacaaacatcgcaggctcatcagagaggttaggcaactaggccaatgtcacacagtaagcgagggagcggggattcaaactcaggaccctgcagcttcaaggccaagctccgccctgtgccacgctcaccacctcaccatcctcacaggcccattccttagagcagaccctgtctgccctgccaggctgcctccagcgattctgtgtatgtgggtacagtgaaaactgaacatacatgtacagtctggaacctgtgggcctttgccacccagccacagcctcctggtgcccaccccatgggagtgctatcaccagacagtgatgggatgtcagggactggggaagcacacagagtccagaagaggtgggaggctggacttcatctggctcctccgggagctgataatctcctgggtgacatcttaaggaggcagtgaggcacagcaccagcagctgctggccaacaaggtgttgattcagccagcaagactcgctttacggggtgggggtgcccccagaaggagcacaggggttgcctagcaatgaacagggctcctcactgggtgggggaagggggttctggtcatttgtcaggtccccatgcaactaggtcaatgtcacacagtaagtgagggaatggggattcacactcaggaccctgcccggtgcccagcctgtctggaaaggggtgctccttggtttcaaagcctcctgtaaccttggctccagcagcccgatgtttcctgtggatgctgaagcccctgaccccataggaaggaaagggcctttcctcctaatcagggctcttctgagaagagcctgggctcaggaagggtgaactcttgtccctttcctgcacgaaaggaaaggggactcagccctggccttgacctcctgcccttagtctcccttcccccacccctcccccacctgtcccgtcagatctacaatgagatgatccgggacctgctgaacccctccctgggctacctggagctgcgggaggactctaagggggtgatccaggtggccggcatcaccgaagtctccaccatcaatgccaaggaggcgagttttgtgtggccagcctggagccgctgagaggaagctcaccgcctgaggggcaggaggggcggggacagaagccagggagctgctccccactcggctgaggctgggacagacaggagaatcctgagtggcagcaaggaggggactcacacctgccccaatgcccccaccacgctgaccctgggagagtaaccaggcaacactgcctctccatttacacagagaccctgacctccagagagccgaggcccacgccaggcctctcagcacacggagcccagcccactccagcctgccctttcccaactgctcagacataggaccctccctgctagccccctcaggggctcctctctgccggagcacctacggcagtcgctaagagctgcctctcctccctcccacccagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcaggtgaggctgggacctgggctgggcagaggagggagggttgacccaggcaacagcggagggcaggaatggtgactcccatgcaaggccagcaccacaggaacaggggagacaggttgggaggtggggacagggacgctggcatctcagcttcgtaggagttggagcggggaggatgtcgcagcgaggtggaggggatgagtggagacccccgggttaaggaagtgaggaacgttccagaggagcagggttggggggaatggggtagggcatcccgggaagagccaaggagctctggtgggaaggggaaggaggatgggggtttctccagggaaggagactgtggctgccctaggggagggatccaggaagacaatgaatgggcccaaaggagtagttggaggcagggagagacaagcatcccctgactgggaggacttgacacatcctgggagaggacccagccagtcacatcacaaagaggagaaggtccccgtcacccatttctggcagcatctttgtcccctctcatgaagcttggctttgtggcagcacctttgtcccctcccatgaagtcctgcttgccgagctctgcagccttggtggcagcaccacccagctggtgtaggtctgggctccctcgtgcaggcaatcttgggggttttatggtcacctgagcaatgaggctgggtgatgtcaccattgctggcactggaacaaatgcaagggaaatgacagtgccagaaagaatgagcagtcttttgtctttgaacatctggggtcggatccgaacagggcaggttcaagaaacttacccctcccttccagtaaagcctggggggcttcctggaaggcacacaggggagaggcctgggaggagagagagtgcccttcagccactggagcgagctggtcccggcttctccaggctgggcagagccacctcctaaggggagctgcaggcagggcctcctcggctttgacatgctcctgcaggcccaagaaaaggagaagaacctgccctccaccaccatgcacatgtgcacgcactttcctccttgctccctggagcaccctctggagcaccagtggtcctgccggctcccagctgagctgcctggaaagcaacctccctcccatctcatccatggcactgtgtgtcaggccgtgccacggcacctgccctgaggagaaccggccatctcagccctcctcagaagctgtcagcccatcactcttgttcagaggcctctgggtctcttaaccttctccaatgccctcagtggccttggcaggaggacggccacaaggtccttgggggtttattacccaggatcaccaggtcattcattggtggggtggctggggagaaacccagtcccctgcctcatcaggccacacgtgtgccctttgctcgccccctagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggtaccagccacagctgggcctgggcactgggcaccaagggtgaggctgccagattaaacaaatgaaaatacagggcacccagctaaattccaacctcaggatacacagcaaaatttattttagcgtaaatatgtcccatgaaatatttgggatattcttatgctaaaacaaagtaattgcatatctgaaattcaaatttaactgggtatcctgtattttatctgacgaccctaaccaaaggctgggcaatgggaaggaaaaggagcacgtgatacccccacccagggctgtgggtcagagccgtctagatttgggggtgcaggtgggcagtcagcctcatggccccacaggtcagctgtttgggggtggcctcctttgtgcaggggtgtccttggccttaaattatagcagcatcactgagcgcccactcctggctggtctcttgaattcagtacttcactctattagctccttagatctcgtcaacaactctatgagtttgagggattacatttgcagatgaggaaactgaggcacaactcagttaggtaatgttcctaagggctcacactagtaagtgctgaaagtaggatccagtcagaggcctccctgatctaatatcagagtcaccgcttacttaacattgccagcagctgccgtcatgactgcacctagaagccggggaggtggggacaattgcaaaaggactgcccccttaaaaagcaaggaaagccgggtgtggtggctcacgcctggaatcccagcactttgggaggccgaggcaggtggatcacttaaggtcaggagttcaagacaagcctggccaccatggtgaaaccccatctctactaaaaatacaaaaattgcccaggcatggtggcagacgcctatagtcccagctactcgagaggctgaggcacgagaattgcttggacctgggaggtggaggttgcagtgagctgagacagcgccactgcactccagcctggatgacagatcgagaccctgtctcaaaaaaaaaaaaaaaagaactaaagaggtgaatgagctttattaaggttacacagctggtaattgctggagcagggctttcttcctcccaagcctcacaccatatgacgctcagcagccgggtcccttaagtgtaaagagacagagagattgcactcgccagggagggcatcgtgaacagcctggcaggaggaaggcctgaggaggcagtccccactgaccacagccacctcccatccaggactctctgggaggaaacagccgcacagtgatgatcgctcacatcagtcctgcgagcagtgccttcgaggagtcccggaacaccctgacctacgccggccgggccaagaacattaagactagggtgagggcccctggaccgtccaccaggacacaccttcctgggctgagattcaagcccccgggctgatccctgccaccccactgcactctctggaaccagccactgctgcactggcctcattccctagttgatcgtcacctgtacactttccctgcacctccaaaccctgctcctctgccgggaagccgacagctcccaagggtccccgcttcctccagtcccaggactgtgctccccctgcctcatcccctcttctcttcccttcctcgtcttcagatgctcatttagacctttgcatttccaaagcacctcttcatgatggtcatcacaggaggcaagcttcattgagcacttgctctgagctgtttcacatgctacctcctttgatcctcaaaaaacagcagtattattgcggttcccatgtacagattaggacagcaaggcttaaggaagttaagtgacttcccagctggccagtgatggcgctgaggatggaaatgagatctgccccgtttccaagtccgtgtcctcacctgtctgtaagcatgtcggaacccttgccatccgcttagaaatccatttccacctgttcgtgtgtggaggagtgggaatggattcatgtatgatagcatgtagggaacattctcccaacacctaacacttgccagctgctgccctgagggctgtaagttttattccaacccctcaatgggggacgggagacacattcttgaaacagctcattgatggttcagaatattcctaatagcaggtaaatgatgccaatggtaggtgctggggcaagacaggaacaggaggtgggggtggcctggtggggtccagtggaactctctggagactgtgagtgggaccctgaaggctgggaggacattccagaaaggtgggagcagggagagcacaggttccaaaggcaggaaggggatggcgtctgtggtgggtatggggagagcaggacaggtcttcaactggagtgggatgttcatgcaggagcggtgagcccagagaaaatcagagagatgggggtggcccttcaacaacgggtggaggaatgaggacgttccccgcaggcattaggaagccactgaaggttgatgagatctagcagtgagtgtgacaggaggttgtggaagtggaggaaaggaggccattactgtcacccagaaagactgggggaggcagggggaagaaaggccctgcaggcaggcctcggtgagtgcacctggggtgactgcatcccctccgctccatacgtgttccctgcaggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaaggtgcgcctgtgggtctgtgtgagtggcagccccctccggccagcctcacgttgctctgggatcaggccatgttgtgttcaaatccagaatcgggctctttctggctgggtggttgagctaggcactcaccagctctgagcctcctagcattcagctgttaaatggggttgtgatctctgcttcagacagttaccagagatcacaagccgatttcccaaccccaccttggaagagtaggtgggatcccacgagggagaggcacgtgagcaatgagctgcgcagggcgcacactaagggctgtggcgtagggctgcgaggtcatgcctgcacccccggaatgggctccgtttccttgtagacctgcatatttgctatgatggttttccaacagacagtaaagctttttttaaaaaaaaatttactaatataaagagagaggcagacagtaaagatttttttttttttttgagacagagtcttgctctgttgcccaggctggagtgcagtggcatgatctaggcttactgcaacctctgcctcccgggttcaagcgattcttctgcctcagcctcccaagtagctgggattacaggtgcccgccaccacacctggctaatttttgtatttttagtagagacgaggtttcaccatgttggccaggctggtctcgaactcccgacctcaggtgatctgcctgcctaggcctcccaaagtgctgggattacaggtgtaagctactgtgcctggccacagacggtagtttctaggggcacctttttatagttggcacagaggtgctgtaagggttagcaggagcccagttcataccaaggagctgggaattgcttttgggcaacagcttgaagactcaatgtgggagtggggtctgggaggatgtagtaatctagggggtcttcctggaggaagcagttggacaggaagtgggagcactgagttgggaagaaaaggaggggaggggcccaggtgggcccaggctttgctagctgaacttgccgcctcctctaccttgcccaccctcacccatcggcagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccgggtaagcccccctcccaggaccctccaggccccacccctgtgcctgggacagaggagcacgacctgtggctgtacagtgtgccctgcccccatggcctgaatgccctgtctctctgggtggggctgcggcagctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaaggtgtccagggtttggggggacaaggagagtgggtttaggggacagggtgagcaggtttgagaggcaaggcggaggggccagggtgggggtagccgtgagacttgggaactcaggccacaaatcctgtgtgactttgctaagctctttaacttctctatgcgtcacattccccacctgtaaaatgggagcagtccatggtgcagccctcatggggttgctgggaagattacataaatgcctggcacataccaaggactcaaaaaatggtaactaatgttataattagggtttttcaggctgggcacagtgactcacacctgtaatctcagcacgttgggaagttgaggtaggcagatcacttgaggccaggagttcgagaccagcctggccaacatggcgaaatcccgtctttactaaaaatacaaaaaaaaaaaaaaaaaagcctagtgtggtggctcacgcctgtaatcccagctactcggatggcagaggaataagaatcacttgcaaccctgcagaggttgcagggagccgggatagcgccaccgcactccagcctgggtgacagagagagatcctgtctcaaaaaagaaaaataataataataattagggttttcccaataacagatctttgccttctgttctgggacatacccagaccaaaggggctttagggtatcatgagccctgagggggtcacatgggctggggttgagcagttatcccccaagctggttccaggggtggtttgcggtcaggatagcaagaaagtggacactgaggggccaccttggagcagtccctgattgtaaggcccaagattcagcttttagggttggcctcaggctggagctccagacagatgcctggagtccaggcgctggagggtcgaggacgagctgggcaggcggatcggacccctctccccgctgccagatgctgacctgcgcctcctgcagctggcgctggagcagcgctgccgggagctgcgcgcgcggggccggcgcctggaggagacgctgccgcggcgcatcggctccgaggagcagcgcgaggtgctcagcctgctgtgccgcgtgcacgagctcgaggtggagaacaccgagatgcagtcgcacgcgctgctccgcgacggtgcgctccgccaccgccacgaggccgtgcgccgcctggagcagcaccgcagtctctgcgacgagattatccagggccagcggcagatcatcgacggtagggcccacgcccccgcgcatctgagccacccgcgggggggccgctggcactcactgagccctgccccttccccagcagactacaacctggccgtcccgcagcgcctggaagagctctacgaagtgtacctgcgggagctggaggagggcagcctggagcaggccaccatcatggaccaagtggcctccagggccctgcaggtgggtgggcgcctgggcggcctgaacatgggcacatgtgcccagggaggggctgatgaccaaggcaatgccttcaggcagctggaggggacaggaccaggctggctggcaccccagggagttgactccctttccttcttaccccacccaaagccttgtcaagcctgagtaagaccctcctccttgggcactcctgggcatcacttgctcccacccagggtctgagggtcagggctggccatctgagatatcacaaatggctccagctgccctcccaggagaccaagcatcaggcagtgccactggggaagcctagcagaccacagcttaaccccgaggacccaaacacaagcccactgcccttctggggctcccaggccatcttacagcccttgtcaccctgtaagcctttgtgactctgtgctgatttggtccaggaccaaatcttctaactgtccaccctggctccctcctccccaggacagctccttgcccaaaattaccccagcaggaacctcactgaccccagattctgacctggagagtgtgaagacattgagctctgatgcccagcacctgcagaacagcgccctccctcccctcagcacagagaggtgagatgggggccacctgccccagcccccaccctgtgccctgtcccagagaggccaacccagactaaggctaaatggggaacacagagcagcaatgagagggagcaggtggcccaggtctggagccaggactcctgggttctctctcctttcacaccaacagcttctcccctggggtgggggtgggacctcggtgagatagcctggtctacagccactcatcttcctctgccaacttcagtgaaggccaccacgtgttcaaggctggtactggggcctggcaggcaaaaagctcctctgtgcccaccccacctcccatccagctcggcagcctggtgacgcaggaggtgagctctcagtacccgatggccccacgagctccactgcagcgggtgcgggacatgggggtggacagcagcagttgggatggaccctttcccaaacggcaccagcttgaggccccgctgtctctgctgagtggggcatggggtccctgctgtgtttaagggtttcctcctcccaaccactccaccccacaggccccggctcaggacagcctgggcagctggatcaactcttcccctgacagcagtgagaacctgtcggagatccccttgtcccacaaaggtatgtgtgccctctgctgcccggccacctcacctggccttgtctaaactgttcagatcacccagctcaaagccctttcctgccctctgcactgccaagtgcaaccaagcattgggtgctacacattctgtagaggcaccattgcccctgaggattagtcagtcaaggacacttaagagtcttctctaagtcaaggacatttagagagatgggggcagaatcggaaattagaaaagagacatgtggcatggagacttatgtcccccctcccccgccgcctccgctcagtaatcactgtaatagcaaatatcgattcaatgtctgccccctggataatgtaggttgagcccatttcctcaattaatcctggaaataaccgatggcattagttttaccatcccccatttgcagatgaaagtgaggctcggaaatgggcccaagtttcttacatagcaaacccctggaagtgctaggattgaaacccaggaggtctggctcctacccacgtctgccatgtcagaggagggtgttgagaggtggccttgatctcgggttgtatgttccccgtgtcccgctgcagagaggaaggagatcctgactggcaccaagtgcatctgggtgaaggccgcccggcggcgctcgcgggccctgggaaccgaggggcgacacctgctggcacccgcgacagagcgcagcagcctgtccctgcactcactgagcgagggcgacgatgcgcggccaccaggcccactggcctgcaagcggccgcccagccccacactacagcatgctgccagtgaggacaacctgtccagcagcacgggcgaggccccgtcccgggcagtcggacatcatggggacggccccaggccctggctgcgtggccagaagaaaagcctgggcaagaaaagggaggagtcgctggaggcaaagagaaggaagcggaggtcccgatccttcgaggtcaccgggcaaggggtgaggcgaggcgcaggggtgggtgtctaggcactcccatagcagctggaggcctgagggctggatttctccaaaggctccagggcacctctagcctaccccatacctggaggcaccaccctccacagtctctgtccccagcctagcatagtagctgggacagatcctggtagcagatccctgtgccgctctcggcctcaccccactgttcaaccatcacagctctcccaccccaagacacacctcctggggccccatcaggcggagcgcatctcggaccacaggatgccagtgtgcaggcacccagcccctggtatccggcatctgggaaaggtcacgctacctttggccaaagtcaaactccctccaagccagaacacgggtcagtatgggcaaggaggggatggggaggggaggcctccaccaggcaggggagcagagaagacacattgcatttcctgcgcctctggctgccccttgctggaagcatggttctagcagaatactcatgggactggcatcctggggtggtgcccctagagagttcaaggccactgggtgatgggagaggagttggggaggcattccgaaaccactgatcctgcccctttccctgttgcaggcccgggggactcctcacccctggctgttccccccaacccaggtggtggttctcgacgggctacccgtgggccccgcctgccccacggcacaagcacccatggcaaagatggatgctcccggcataactgaggggccctgcctggaactggctctctcacctcccaagactgaatggggtctagcagggcatgggaggtggaggctgggcagatggagatgaccaggaagtaagctcaggatctcagcaggccagggctcctgagacccaggaactggggtctctgcccaaccctcccatgctttcagtgccactggggaaaagaggtgaggccaggggacatggccaggacggctgggctccctggcttcccagccctggacagaatgctgttgccaaaacctgcacagccctgaggccagcctcggccttggtaacggaggaaagcagctgacagtgagacggggctcctggcccacgtgtggggcacgggcatcctggatggttggggaggcgccgacaggcacttcacgtattacaattggggatgtgggtgagggagggaatctggttttgttacttggcagtggttttttctcacccttcctttttaacaataaaatcccatttgggtcttga

SEQ ID NO: 365 - DNA, 5403 bp, Homo sapiens
  source 1..5403: mol_type = genomic DNA
ttaccactctgagcatcggtttattcaggaccaagaacgttccttcaagtcagctgtgaaatcagctcttgaaaccaggcatcttgtctaccacgcctcacctggactccaccccagccctagggtggccggcgcctggccatccaggggaccaggcttgttgccacctccaggctcgccttgcccttcccagacccacagggaccacctaggccaggcctttattcccagaccccgaggctacttgggggtccggataagggtgtggtatacgggcttgacgatgaggtgcaggtgcagggcgttctcaaccaggtactcggagttgcgccgctgcaggtcggcgtgcgccaggaagtcgccggcctcctcgctgctctggtggaagctgtaggcgtggcggaccagcaggcggccctgctggcgcgcccccaccagcaccgtcttctggaagctcacgcccgccgcgtcgccgccgctgctggccggcgtcaccaccagccgcggtcggccgtcctccgggcgcgcggcgggcagagcagtgcccgcggcgtccgcgtaaacgggccgcaggctgacgggcagccagcgcggcgagaagagcacgttccaggtgacccggcggcccgcgtcgtggccactcgggcccagctgcgtctggaagctggtgctgcggtcgtcgcgggccgggttgttgatgacccacggggcgccccaggcgggcgcgaggtagttgcggggcaggaaggcgctgccgttgacgtcgaagaacttggcgtagtgcagcggcgacgcggcgtggaactggtaggcctgcagcaggaggtcggccaccgcggggccgtggcgcgccagggctgccgagcgcgcctgcagctggaacagctgtgccggtgggatcatggggtagcgtatggcgcgcagcgcccgctcggccacggcagggggcggccgcgcgcgacccagccaggcctccagcgcgtggaacagctccagttcatcctgcagcaccaggtccgagcgttgcaggagctgccagagcagctcggggctcacggcgccccactcggtgctggccgccacggccgacaggttccaggccaggaactgcaggcagctctcgcgcagggcctcgtccccggtgcccaccgcgtagtggtaccagcccaccgccgggcccgcgcctcccgccaggtgcgcgcgcatgtagtcggccacgccgcgctgcagggaggacacgccgtacttggtggccagtctgtgcagggggatggcctgggtcagcagcacggtcagctccccgcagtacaggtacctgcgggagagaccgagaggtggggcggggtcagggcggtacccacctcccaggatagattttttagagtccacaggggacccggcctggagttggagcttcactgtccgggtgcaaacacagtggaagccccaccctgaggcttcccatgttttcctttcaaggacccttccaggccattcttacttcacaggctcttctttccgtttccgcggtgatgtagaaattgcctgcattgactgtgcctctactaggcgtgcagccctaggctggaacaaaacagacgtggctcctgcctttggggtttccagtctggttgggatccatggcctgccttctccttgccatgagtctgggcaagtcacttaacttcagtgaaccttaggctaatcaatcacctaggaaagggggagtggcacacacccctcagggttactgtgacaaccagaggagaataaagaatcttgctacaggccaggtgggtgctagtggctcacacctggaatctcagcactttggaaggccaagatgggaggattgcttgaggccaggagttcaagaccagcttgggcaacatagcaagaccctatctctacaaaaaataaaaaatgttaaaacattagtcatgtgtggtggtgcacgcttgtagtcccagctgcctgggagtctgaggtgggaagatagcttcagcctaggagttcaaggctgcagtgagctatgatcatcatgccacgacactccagctttttttttttttttttttttttttgagatggggtctttctgtattgctcaggttggtctcaaactcctggacttgagcagtcctcccaccttggcctctcaaagtgctgggattacaggtgtgagcccccatttcttttttgcagcctcacctttctttttcctctcctactgttggtgatcacttctgctgagtatctcttcgtcttacttctgccactgtcccatggctcacctttcctgccagtccccaccggcacacggcaccgcacttgcctctataggagtgtggcagccactgccagccatcttccccaacgtccatttctcccctttcccctgcgtgattgcctctgggaataaaagaccacatttcccaggctccctcattctggccttggccatgtgactaactgctggtcaatgggcgcagtttgggatttgcaggaaggctgattaaatgcaactgattccgggttaacaggaagaccctttttgcccttctgtcttatcccctttcctgttgcctggaacttggaagcaatgtatggaattctgcaggcatctcgtctgagccgttagaacagagttactttcttagacactagtgtgaatggcaccccctgagcagcatcacggcaggaggcaggaggtggagagagccgtctaactttttcagctccctagccctgtggttccaaacctggccaaacaccaaaaccacagcgatgctttcaaataaaaaatattcgtctataatggaatatttaggaaaataaaaagtaaataaataaaataaaataaaaaatgattgctggccctaaccctagacctgaaactgacaatccaggttgggatccgtgaaactgtagtttttttgtttgtttgtttggttggttggttggttggttggttgatttttttcagacagaatcctgctctgtcacccaggctggaatctagtggcacaatctcagctcactgcaaacccaaactctgcctcccaggttcaagccattctcctgccttagcctcccaaatagctgggattacagtcgtgtgccaccacacccagctaattttctatatttttagtagagacagggtttcaccatgttggccaggctggtcttgaactcctgacctcaagtgatccacctgcctcagcctcccaaattgctgggattacaggcatgagccaccgtgcccggccccaaaactgtagtttttaaaagctgtctatggccaggtttggaaacagctctgagggggttactaggaaccgaaagtgacatcaaactgcacagatgacacgggcaaagacagggagctgtacagtggaagaagggatgcaggggtcactgtcatcccagtgatgtccggggaaatggacataacaacctctaagggcctgggcttccctgaccctgtaggtggaggagccgggggctgaggaagggatgaagccatcccctagtcttccgcgtccccacctgatgaacttgtcgaagacagcggcgcagtcctgtggctcctgcagcaccgcctcgctctggttacttagcagctccaggaacagctcactgtgcagtcccagcagcaggcggtgggcgtggaatacccggacctcatcggtgcccgcagcctgcacccgcagaaccacatcgctggcgttgccctgccgcagcagctcctgcaagcgctggagcaccgcctgggagtggttgatggaggtgccagctgcctccccgccaacatcggctctctgtgctgcagcaggaaggaacacagcatagcctgagaaggtgcccgggcccagaacctcagtcaggggtggagagggaccagctggagacatatgcatgggtgtgagcagagggcaaggtgggcctaggcgggttgtatgtgcatacctgtttgtgcccacgaggcgcgtggatgcatcggtgcacatacaaacgcaccctgggtgggaaggtcatgccaatgcaaaccccaagaggatgctcttggaagggggtgcattcaggcagggggaggttgtgctcaggtttaggacaacatgcccagaactcatctccatgctgccagccccccaggcaagggttgaggaaactcgtggtcccacccttctcacttcctaaagaattatccatctaaccccttggagcagtagtcagaagtggtgcattcactaacaaatatttattgagcacttactatatgctagacattctcctaagagcttgggatgtggcagtggacaaagcaagccaagttcttatgctcataaaagcacgaattgacatatcaaacgggtaagacacacacaaataagcactccagttttaaaggagccagccagggaaccagtgtcaaggcaggctccagccccgcaaaggcccttgaacggaatgggcctggggtactgggagcagagagagcattagggaggccacagcagtagcaggagagaggggcgggtgtgagacgaggctgcgggtgtggaagggaagctgttttccaggcccagccctgccctcttgggtcctgatctctgagacagaagccgattttctggggtggccagcaggggacaggagaaagtgcgaagggccagctggtgctggaatagaacttcctgggtaactgagcattgaggctggccaggccggccctttgcttatgctccaggatgccccgacagtcagatggggatatgcactcagttatagaaactgtcagcagctttcccaagccgagaacagcgaggggagcctcgcagagggaggcgggcgggggcctgattgcagcagatgggccgcagccacatgtgcacgcacagcacatgcaggcccgtggtgcacacaggagagaaggctcacacaggagcagagcatctgtgcatgagagagggaggccgagggacaaagggagggtgaaagagaagcgggtagtatgtttcccagcacggccttccccagctgtcactttgaaggacctgaatgctgatggcgtccccattcagcctctgcccaggacaatgggcaatggagggtcctcttgtccttaagagccctgcccacctgcctgccaggcccctccttccttcagacagatgagtccgtggagctgtccggtccaccccgtgctctccccagcagctggacaccgccccctcctggccggccgcgtgcagccagggctgggacgacctgccgctccaccctgccccgcacctggcccactgcccgctcacctgcatgggtgaccaggcccaccaaggtcagcatggcccagaagctgccccaggacccaggcttggagtagcctctcctaggcat

SEQ ID NO: 366 - DNA, 5095 bp, Homo sapiens
  source 1..5095: mol_type = genomic DNA
atgagtattatgatgttgcccatggagcaaaagatccagtgggtccccacttccctgcaggacatcactgctgtcctgggtacagaagcatatactgaggaagacaaatcaatggtgtcccatgcacagaaaagccagcattcttgtctcagccattccaggtggctgaggtctccacaggtcacagggggaagctgggacctccgaataaggccatccaaggactccagcagtttccgccaggtgaatccagctgcctcccagaacaggccttctatggggtgggatggtaagttgctggaaggacgtgcatggggcatcattgtagcaaactcagtccccctcctccatctctccctctcctcgctctgaatccagggagctctagttttctgtgtagcctgtgtgacagccttggttgaaacccttgtgttccgtctgaagaatatttaaggtttccagtcaagtgtacatccctcaaagaaacaaagtgggcttggcatggtgactcacacctgtaatcccagctctttgagaggccaaggcagaaggaccacttgaagcctggagttccagaccagcctcggcaacacagcgaggccccaaactctctctatatctatacataaaatttaaaaaacaaagtgtagggacagggtgggcactcggtaaatgttggcagggaccctccttgcccctcacccatggcagctccttgaagagagggtcagcctcctctcacccctagcctcctgctgcaaggaggtggtggcctggggcgtcatctgtgctacttgcactttctggggctggggtcccagcactccaccagaggacctgccctgagcgggcagctccgtctccagtcccactgtgccacccagggtgcctagccaaaccatgggactttcaggcttgcagggtcaggatgtggccaccagggggcagcagggcctgcgctgtgagtatccgagggggggttgggatggggagttccaggctctgatgtgagatctaactcccagagctgggaagctccctatatttcctgccatattttctgctgcattcccagaggacaggccatgggaggtgattccaggggggcctgagctctcctcccgagaccgtccacggggcatccatgtcccgggtacctgcttgtgggctgctctggtcactcttcctctagggcaggagagccagtctggcctcttctgagtgcacaccagcaacggctgttgtttatttgccagggattgatattcttgagggatggtccatttcaccagggccagggaaacaacagcttgcaggactgtggtttcccagcaccggctgcaggcagcctcgtccggctgctcccagaggatgccccaccctgtgcacggctgcctgccatcctgcccctgggggtagcctccacctcccccaccatggccactgcaggactgaccctgtgcacctggtcccctgagcctcttgggatcatagccctgtctgtggcagccttaccactcctacctggcacgacttccccaactcctcacagaggtgccctactctcttccctttcagtctggatgctcatagagtcagcaccctgagtccttctgcctgtccccaaagtcctcagccccaggtttgaccccagctgaacacaggccagctcacagagtgccccggggcacgaggcagccccccagaacccccatcctgccatcctgcctcttctcctcacttcctgctcccccaggcatagacatacctgtgaaccccatgccaccctcagctcgtctctcctgaagctgaagcccctgcccagcccgaccccttcccctgcctgtgcgccttagagcaccctggtttgctccaccagcatctactctagctctttccccggtgcctccgcccaccagttccttcctcctccttcccccgccccgccccctgcactaacaggctcagtgtctgcgtaaggatcctggggcaaacaaccacttggagagccaaggggtgagaggtacagctggcgatgctgacagggagctgcggggaccctcagaaaaagccacaggtgacccaggactcagggccccagagcatggggcttgagggacgagagacaggtaaggcatcttgaagtggggtgtgctgggggcaataaggtggaaaggcaggagggaacaggaggcaggttagggacctagagggtggagtaggggccaaagctgagagtgagtgagcagtgagccccccggcctcagcaggaaacgaaaagctggagttcagcctgaaagagacgcgcagtgtggcttcaggggaacaggggccagagtggacggtgcttatcctagaccagccaccttacccctgtggactgagtttccccatctgtggacttgggccattccagctttagtggtgctcacctttgaagagggtatctttagtttagaaaagagggggccctaccaacagcctctccttagagggggacagctgttgagtggagctgtgcagacctggggcctccactgtggacctcctagagaggtccctgtgtgtggctggcatcacccgggtcggaatcacccaggttgctgattacaagcacggctgctgcaaccccgcttcagaccctctggcccggaggcggcccaggagcctgcacctcgacaagtgccccctgtttcagagcccctgctaggccgggtgagggcccatggggaggacccatggggagcaatggtctctatggcagcaggccgtgctgccagggacttcccatcagtgggggagccgggccactgagggagtggggtgacatggggtgggggtgagggtggtcttggcaagaattctcacagcaacagacagtgcactcagctgggtctgactagagggtctgcacagagcagggtgactagaaagaccccaggtcagggcggggctgcgcccagccaggttagaaatagaccagaggctctgactctgcccatccgcaccttctagctggccagccacgagtgaccctgctgcccacgccccacgtcagcgggctgagccaggagtttgaaagccactggccagagatcgcagagaggtccccgtgtgtggctggcgtcatccctgtcatctactacagtgtcctgctgggcttggggctgcctggtgagtggggagctggggtctggggacttgggcttggccagaaatggggatcctccttcaatgggtgccagtcctctgtgtttgacccctgaggccctggatcatagacccctggtctttccttgccattgtcagggtgttctgggtcactggaggggaatacaagtaaggggctaggattgggggtgctcacagctaaacccaagttttccccagcagtgagcgcactcttaggataacaaaattcacataggaactggctcagctcagtacaaagctccccgtgctgcccatgccttcagagagcagagcttggggcagaggtgggtgtgtggatatgggaaggacgggtggtctcggccctggggatttccccaagtctgatagctaaacccatgcctgtgtctagggacgcctccattctggaggacacagaaaacctaaaaaggacttggaggacaatgccataggacaggtagctttttttttttttttgagatggagtctcactctgtcacccaggctggagtgcagtggcatgatctcggctcattgcagcctccacttcccaggttcaagcaattctcctgcctcagcctcccaagtagctgggattacaggcatgcaccaccgtgcctggctaatttgtatatttttttaacagagacggggtttctccatgttggtcaggctggtcttgaactcctgacctcaggtgatctgctcgccttggcctcccaaagtgctggattacaggcgtgagccaccacacctggccaggacaggtggctgctgaggacccttccatgtgcacttacctgtgcataaccggggtacagccagtggcctgcagtggatggacagggcagagctggcctgggtggccttctgggcaaagtggggtttcagaaggatctggaaggagaaaaaagagaagccagcgcagcctctgcacatgcagatggggaggtgcgatggcgacaccttggaaagcagagtctgagctctcttctgatgcctctcccctccctcacctcggctgccctcagtcagcctcctgaccgcagtggccctggcgcgccttgccaccaggaccaggaggccctcctactactaccttctggcgctcacagcctcggatatcatcatccaggtggtcatcgtgttcgcgggcttcctcctgcagggagcagtgctggcccgccaggtgccccaggctgtggtgcgcacggccaacatcctggagtttgctgccaaccacgcctcagtctggatcgccatcctgctcacggttgaccgctacactgccctgtgccaccccctgcaccatcgggccgcctcgtccccaggccggacccgccgggccattgctgctgtcctgagtgctgccctgttgaccggcatccccttctactggtggctggacatgtggagagacaccgactcacccagaacactggacgaggtcctcaagtgggctcactgtctcactgtctatttcatcccttgtggcgtgttcctggtcaccaactcggccatcatccaccggctacggaggaggggccggagtgggctgcagccccgggtgggcaagagcacagccatcctcctgggcatcaccacactgttcaccctcctgtgggcgccccgggtcttcgtcatgctctaccacatgtacgtggcccctgtccaccgggactggagggtccacctggccttggatgtggccaatatggtggccatgctccacacggcagccaacttcggcctctactgctttgtcagcaagactttccgggccactgtccgacaggtcatccacgatgcctacctgccctgcactttggcatcacagccagagggcatggcggcgaagcctgtgatggagcctccgggactccccacaggggcagaagtgtag

SEQ ID NO: 367 - DNA, 15902 bp, Homo sapiens
  source 1..15902: mol_type = genomic DNA
agaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggaggtgagtcggggcggggagggccgggcaggctttgttcctgtgtaaacggagcgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcctcggtcccagggagaggcaggccctgcgtcccggcccgggccccgccatcccagccaggaccgggcctggcccagcgccccgcgccgcgtccctcccacccccgcccgccccccgcctggggctggagttggccccaaacgctgcgctggagcggggccggcggcgagtcccaggtaagggctgctgccttcccgctccgccgcccggaagagtcgggtcgggacggcggggagtgggcgagggcagaggcggggggactggacatcctgcgggctggggacgccgcgccaactccgctcggtcgctgaaagttttcaaacccgagccggctggggactgggggggtgggggagcccggcgctgcggctcgggctggagggaggggaaaccactccataatcggggtctccaagaggagcccctccaccgcctgcctctcggtgggagtccgcggtcactctctctcgtgggtggcgtcctctctgccgcctgctactgtggatgtggagggcaggtttctgtggccctaaaaatgggagagagtgactggttcccttgctccccattccagccacccagggagcgcaggtgtagaccccagtaccgtcgacccaagtagggacgagagggttcagaatccccctgagggaagtttggaaattcagactatcaaagcgcctccccttctggtagcctggcccctagatcccgaacccccactcccggctggcttttccagcgtcctttgcacctccatccccaggcccgcagtgttacacgctggaagacccaatcacttacaaactccacgatcaagatcctaaagcccgggagaggagactgttggaagtagggttttgtgctcctggagcttcctctccccgccggccccccacccctgtgccttcaactggactgggggagggagtgcattggggggtggggcgcattccagagtgacattccagagcagacccttgaagatttccaagtctcagagagctcagggcattttggcccaaatgcctggtcttggtgcggggcaggggcagggggataggggtggggtgtctaggctgaggttcgaggaaccccaacccaccccccaccaacctacacactgaggccgctccttccaggcacaggcgtctcctgtgcgccttcttatcgatggggtaaacgcctgagcgccctgcacagaggggtgagacagtgggacctaaccagggactgggagagaccgataggagtggaggcaggaaggctgtcagtcgggccatcgtctttccctataggctcttgagtgtgtgggatgggaggaaggcaagtgctctgtggtatccctgggggaacctccctgaagagtgccctggtcacagcacccttgaagacagccattggccatgggtcagtgttgagtttggttggccctgtgacgcgctggagctctctttccagtgcggtatccttggccctggtgggtggagggggtctcaggcttgtgtgtggatgatgctggagcgaggaagggagttttgctctggagaagtgagaaggcctggctgtctccccggttgctggatgaagccacttgttgctgggggaaaccagtcagggctgcttgggcctctgggcctctgagcctctgagcccaccaggcctctgcgccccctggagagagaaggagggaggagggaggttcagcaactggactgcactgactcacaggagagctgggggcagggtggctgagcctggggaaaggccgatttcggaggcgattaaaaatatttgtacaactgattccagggaagtgaagcaaaaggcccttttgtccagaaaataatctgaggctggagctgggcttcagctgtggggtgggggagactcagggcggaaggaggttcccctcctacccccctccttgaaccctctgagaatctttaagcagaagatgcaactccaacatggaggggacaaccctgggtgtggagaaatgcacctgggaccatccagaggtgacttccaaatgcccactgtgttcaggcacagcaccagctgtggcagtggattctagaagtcttgttcaccagcttcaaagaccttacagccctggaggggagacacggacatgatttgaacgttcagggatcagaaggctcagtcttagtgcagggtctggggacccacaggaggcagaagtttcctccagggtcctgaggaaaagcctctgaccagagctgagtccatcttgtcagtcccttagccaccatcttaaaaggtggcattgggccgggaacggtggctcacacttgtaatcccagcactttgagaggctgaggtaggtggatcaccttaggtcaggagtttgagaccagcctggccaacatagtgaaaccctgtctctactaaaaatacaaaaattagttgggcatggtggtgggcacctgtaatcccagctactcgggaggctgaggcaggagaattgcttgaacctgggagttggaggttgcagtgagccgagatcatgccattgcactccagtctgggcaacaagagtgaagcttcgtctcaagaaaaaaaaaaaggctgggcgcagtggctcacgcctgtaatcccagcactttgggaggccgaagcgggcggatcacgaggtcaggagattgagaccatcctagctaacacggtgaaaccccgtctctactaaaaatagaaaaaattagccgggcgtggtggcgggcgcctgtagtcccagctactcgggaggctgaggcaggagaatggcatgaacctgggaggcggagcttgcagtgagccgagatcacgccactgcgctccagcctgggcgacagagcgagactccgtctcaaaaaaagaaaaaaaaaaggcattggctgaatgtgcactcccggcatcagagggctggagctgtgctcttctgagcttctctttaactctctgagggtccctgtcctaggcagtggatgagagccacgcccagaaagcccaggtttcccacctgagtccatgtatttctgtcttcccacctgcccttccatttctgggggaaccagagaaataagatatttcaggatgggaccaggttgtttcctctgaggctgttaagttactcagcaacttactaaaagcagcagcctggctgctgggcagcagcatggtacctggatgcggtgaggggcaggtacaggctcctctctcattccttgaaagtttctatattgagggggttggcaggagaagcaagacttgaagggtcaggtgcagaaggaagttgctggtcaccaaccacaaaatcagggggaaactggaggtgggggcttagggacagagagctgtgaagctttcctgaccctagcccaagtgcctgtgggcttcttggagccagcagggtacaggcaagtatttctagggcaagatggatcaagaagaatgagtgacattggtccctggcttggttttctgtaatgacatgcctgttagatttgaacttgtagtatgggctttagtatccttttcccccacctccgccatccaaccagtccttcgattgttttttggaaaggatctttcagagctggccattatggctttacctttggccttgacctttaaactggaatgaatgtgccccccaacaaatcgattgcctgtgcatttttgccagactcttttcctaaaagcgcaaccctggctatgcccccatgatgctaaaagcagccttcagtggctgcctgttgcctttaggataatgcccccagccccacccctgtagcatttccaatgtgtcagccagcagctgcagcctccctttgcagactcagctgatacttggcaaactgaattcttttttaacttgctctggacttgggctcaaagggctttgattcacaccatcttttctgccttgcacgtccctctccttgttcccttcacctgctcagtccttcctcacattcttcagggcttagcttttgggtgtccctgtctcttggcagtgtctgggacctggtatgtttttttattagattctgagtaaaactctgcggaacagtctttctctactctgcctgtttctcttctgtgttcctgtagcccctgtctctctcctgcaggtaaattccgttgtgtggcccttaatcatattcttccttgtgtaatttttgtgagtacctaccttatctctcttgatagattttaaatgccatcaagtcagggactacgtttgttcatgtttgtattttccacagctctgggaacaacagggcctttccttcccaggcgcacagtcaatatttgctgatttggagtaattgcctgttctaaactgggccctggccgagggaggtggggtgaaaagcccttgaaagtgcaggtgtccggagtctaagtggcagttctgagggttctcttccctacgtccagcttcaagcccaagttctggctggtttggctgtggagcccaagatgaagttgaacatttaggatcccacagcttgttgttatccataaattatctcccaggagtgggtccatattacgccttcccttttttgttgttgttgttgttgtcgttgttgtttttggtttttgagatggagtctcgctccgtcacccaggctggagtgcagtggcgcaatctcggctcactgcaatcttctgcctcccaggttcaagggattcttctgcctcagcctcctgagtagctgggattacaggcgcacgccaccacacctggctaatttttgtatttttagtagagacgtggtttcagcatgttggtcaggctggtctggaactcctgacctcgtgatctgcccgccaaaagtgctgggattacagcatgagccaccgcacccagcctactccttacctcttagccctctcttactcctctttccagcacttgtaaataaaatgcagttggtgctttattgatttacaaagtcccctacagaagcttatttaagtcctgcattagaagtaaagagaaactagccattagaacgccagttatttaggaaaacaacagtacatttacatgagatagttaattttaagagttaatcttaagcaagcttaattgaaagatgaggtagctgagatggctaagacgacctaaatattttcaagtggcatggagactatttgaagggactttgaaaatggatcctctttattgtgtccatttcacttaattttatgagttgcattgcccctgatttagtaagtgttctttcacataacaattatggacagaatttttttttttttttgcttctgtgttgaaaagagggacaatttctatcaactgtgggatttagggcttttgtttgcctattagaaattaagtagccaggaatggtagaaaacagtaaggaggtaaaccatgtataaacaacctcacaatccccctaaaaaaggaaaaagggtggcagcctcacagaagagagttagataatgccattcccctgccagccactagtggtcactgtcagaccaggaaagcttggttgctgttttcccagagagttcctgatgaagctgggttacaactagttatttgaacacgtggggtgacttaaatgtggactacctgcattcatagaattttgaaacgtataacctgtttctttaagcatttaaattttctttttcttttcttttcttttctttcttttttttggaaacagtctcgctctgttgcccaggctgcagtgcagtggtgcaatcgcagctcactgcagcctcgatcccctgggctcagatgatcctctaacctcagcctcccaagtagctcagactacaggtgcatgccaccacactctctgctaattcatatatatatatatatatatatatatatatatatatatatatatatttgttgttgttgttgttgtttgttttcatacagagtctcactctattgatcaggttggagtgcagtggcgcagtcttggctcactgcaacttccacctcccgggctcaagcaattctcctgcctcagcctcctgaatagctggtattataggcgtgcacctccacgcccggctaatttttgtatttttagtagagacggggtttcaccattttggccgggctggtctcgaactcctgacctcaagtgatccaccagtcttggcctcccaaagtgctgggattacaggcgtgagccactgcacccagctgctaatttttgtgttttttatagagacggggtttcaccatgttgcccaggctggtctcaaactcctggactctagcaatctgttcaccttgacctcccaaagtgctgggattataggcatgaaccaccgtgcccagcagcatttaaattttcagtgttaggtttcctccaagtacatttaaaacttttgattggaaaaaaactcattgatttggtctttaatatttcttaacctgttaaatccattacctccacttcacgtgggaaaatccaattggtattgggagcaggagtttggttttcttctctggcacagatctgtggcatttggtagagcggcagtcagtagatggagtgaaaattaccttgctggtgttaataaaagctaattttcttgccttctagctacaacgtcttaaagtcttctattaaagattaattcctttgggttttgcattgcccttgcctggttcttacttttaaaatgttaatgctccgaaggaaaatttttgcattaagtcattaactccttagctggggacttcgtttatttcacccttgacttccgcttccgagctaggcaaaaaatggaggattctgaactggagacttggcactaaaagtgggaaaatgactgtctcttcatttttcctggctgttggttatgcctgctgcagctgcttgttaagtctattgaatgaatgaatgaacacatagctgactggctgtggatttaggcctcacaggaatggagtttaggggcatagcagctgacctcctgaagcctgaaagtcccagggcagagaggaggtactgggtgggtggtatgcttggtcttgacttgttcacaagccccttcatcctccaccgtggccgccagagctcagggaatatctgaacccaggttatgtttggtggaagggagggaactgaaaattcaatgacaggtttttcttttgccatggctaggaatagggctgacaaatgggcttcatctcatttgcctctgtggccagttgaaatgcctctcaggggttctatgttaagaaggattctgaggtccagagagcctcacggtcagcagctagcactatctgcctgggtttaggttgggggaagcagcaccatgtatattggagtctgatcttggaggactaattttgtcccttttccttctgtctctagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcaggtgggtctctgtggatgcccccagtggcccctttctccatcccatgtcttttactgcaggacagggagccagtctcttgagcaaaatggaaagtttttgaggttttctgtagttttctgcctaagtgtctctaaattccatttaatttaaagatttttttttttcagttgggcatggtagatcatgcctgtaatcctagcactttgggaggccaaggcgggtggatcacttgagacgaggagttcgagaccagcctgatccacatggtgaaaccccgtctctactagaaatccaaaaaaattagctgggtgtgctggctcatgcctgtgatctcagctactcgggaggctgaggcgggagaatcacttgaacctgggaggcggaggttgcagtgagccaaaatcgagccactacactccagcctgggtgacagagcaagactccatctcaaaataaataaataaataagattttttttctatattcatataattcatgcatacattctcactgtaaaatttcaaacattacagataaaatgaaattttccccagctgcctccccagtcctacccgtcccatcctgttccatccccagaagtgaccactattgactgatataatatctatgtgcctttgtttctccatttgtaaaatggggataatgtcagtacctatttcatagggttcttgtgaggattgaattaattagtgccggctgggcgccatggctcacacctgtaatcccagcactttgggaggctgaggtgagtggagcttgagcctaggagtttgagaccggcctggacaacatagtgaggccccgtctctacaaataatttcaaaaattagccaggtgtggtagtgcatgcctatggtcccagctcctcaggaggctgaggcaggaggattgcctgagcccaggaggttgaggcttcagtgagccgtgattgcaccaccacattccagcctggatgatctcaaaaaaaaaaaaaattacttagtgcccggcccatgaaaagcactcttgaagaattagctatttgctgtgtgtgcgtgtctattattttacatattttactaatactatccttccagaacttgtttttctattatgtatgtatccataatcaccttagttttctttaaaaggaagtatttttcaggtaatttttttctctttttttattttttgagacggagtctcgctctgtcacccaggctggagtacagtggtgtgatcttggctcactgcaacctccgcctcccgggctcaagagattctcctgcctcagcctcccaagtagctgggattacaggcacgtgccaccacacctggctaatttttgtatttttaatagagacgggatttcactatgttggccaggctggtctcgaactgctaacctcaagtgatccgcctgcctcggcatcccaaagtgctgggattacaggtgtgagccactgcacctggcctttttctctttttaataaaagtatttggggtgccgtgtagtggtctcagcagcgcccttgttagctgtacagcccactagcatttcctcagcacctgctctgtgccagcccctgtgctaatccccttaccgatgtggcccattgcacgcatcccacctgctcttcctcagcctgctggctgcagcccctcatctgacatgacctggaaatttgggggtgccatctcaaagtcctgaccctgcccccagactgtgctgatctggaggcctgggggcttcagactttcttaactgcccggttaacaagcaccggctctggggtctctgctgggaggtcagagtcaggcagtggaagttccagaatcagagacattcctttctcttctacacactgtgaaatcctcataatccctgctttggagaaagagatgacccttgtcctgccgggcacttgatctttgatctgcccacctgggctgaggtgctggcctcacccctgggtggcccctgtcacacgcacggtgtgcatggcgggggtggaattggcaaaacccaccagagaggtggggcttacagacaagtgctgggaggagcctcaggccccgcccccacactgaatgccggtcggggccaaatggttctcaaccttggggctgagtttttacttcctttttttttttctaaatggaaaaatcaatagagtgagcccagccccagcacttaggaaactctatataggttgcggtccctcagaactgcagggccgtcagccttgccggagccagacgtccgctgtgccgtcctcacagcaaggcctgctccgaggccccggggtgcgtcagcagccctcctcaaacaccctgggagtgcccagcagggcggaacacaccgggaaaccaacaccccaaaggcacaaggaagtatccctggagctaaaaatagttctggaaacttgccagggggccacaggctgggacgtgcgttaaggctccctggccaggctctgggttggtgtagtggggaaggggcgcccaggtcggccctgggaggacatgaacaggcttaggccgagggctctcagatgtatttacctctgtgcctggcagctggcccgtggtgacaggcagagctggaggctggccatcttggaaggcggccgaaggcccatgtgtcctcttggcctctggccccggagggcggatggggatgtggaagttgctgacagagcattttctgagctgttgggtcaggggctggggtgtctacagtgcagggaagctcagcagtgttgttcactcccatgcatctgtacaaaggggtgctaggcttgggagggggcccccgtgttcacaacctcacccccaagttggccactcctgggttagagactatgccagggttggcctgccccctttacctcttccctgcccccagagagccttgcttggtttgtgggaggtggggaagggagctgagagccctgggatcttcaaactgttcctgcttttccttgtagctaagaggccggtgtcaccatacagcgggtacaatgggcagctgctgaccagtgtgtaccagcccactgagatggccctgatgcacaaagttccggtaagtgggttccccaggtccccgtgacacgtctgggctacagagaccagcctcagcaggccagtgggagaaggccatgtggccagagctgggttgggtggaggtggtaaggggaaggcaagcttctccatctggtgcttttacctggggaatccagagccccagttcttaaattccttgtcctggagtcagtgtacccaccaccttcagctgcactgcagtgggacccgccctgtgtcactggggcattgcacacaggttgtgtcgggatgctatagggaatgctgggtgagctctccctggtgggagctgccagctttaccctggagggcttggggagggacaaaggagggtctcagccaggtgctcccaaaatagacaggggtccaaatgtcacaggtctggataggtgtttacttctcaaccacagctgtgccaagggggcccacactctcctccctctctggcaggcagcaagtctcgaccttacacctccccctgggttctggaaactagaagcatcgttagccaggggagggggagggagcaggaagacggtgggttggattctactcactcctatatgtgttcctcctcccggctggcagaggctgtggggagaggtcagtgacccgtcttggcaggacactgggaacaggaaacaaggaggtcagctgggtggcgttctcatccccctccccgccctctctgtgagagccgcggggcagggggaggtgagtgtggctgaagcttccaatcccagcgcctcccctctccctgagcctgaacctgagcctgggcagaggagagcttccggagcaccaggagtggaggctgcgggctgtcagctctggcggggagtgggcagccacagaagcctttgctgaatagcttccttcactgttgctgcacctcactccccagcgcgtttggagtctgcttcctgggggatgatctggattaacagggatattttatctgaccggttctcaaaacatggtacccggaccaccagcactagcctcacctgggagcctgctcaaagtgcaaatgggggccaggcacaatggctcacacctgtaatcccagtactttgagaggctgaggcaggtggatcacctgaggtcaggagtttgagaccagcctggccaacatgctgaaacctcatctctactaaaaacacaaaaatcagccaggcatagtggcacatgcctgtagtcccagctactaggaaggccttagccagaggatcccttgaacccgggaggtggaggttgcagtgagcacagactgtaccactgcactccagcctggacaacagagtgagactctgtctccaaaaataaataaataagaaaaaaaaaaaaaagtgcagatggggcggggccagagctgggatggagctgactgttagcatccgttcagggcgtcggcaccatgggggcactatccagcgcagatctgcaagcccagcattcagcactccctcccccagccccagctgttgccagctgcatggggccagctgtgttgggtggggactgtgtagggtccagctatgagttggtggagtctgcgtggggactgtgtagggtccagctatgagttggtgaggcttaacaagcagtgcaggtgattccaatgcacactcatctgtggttttggaccacagatgtagatgttccagggaccacatggacaggggccattgcagacaggcctgaggacctcctgggcctgattgacttgaaggctagtttggggtctgggagctacagagatttggtggcagctctttcccatagggctaagacagatggggccaggaatacacctttcctccagcataggagccggaacaggtacctcaggaccctcttcaccccacagctggtgtctctcacccacatgggagcaagacccagcgccaggcagagaattcaggtttcaagactccaaatcagggctggttgcagtggctcatgcctttaatcccagtgctctgggagactgacatgggagaactgcttgaggccgagggttcgagagcagccctggcaacgtagtgagaccccccccccccgcccaccatctctacaaaaaaaaaaaaaagactccaaatcagaccggccagactagatgcctagagagatgtgtgggcacacccagagccatgtcctccgccagggaagccagcaactgtgatgctgggggtatggtagtgacaggcggtcgactcggggtaatattcttggaggagccgggcatggtggctcacacctataatcccggcactttgggaagccgaggcgggtggatcacgaggtcaggagattgagaccatcctggctaacatgatgaaacaccgtctctaataaaaatacaaaaaattagccgggcacggtggcgggctcctgtagtcccagctactcgggaggctgaggcaggagaatggcgtgaacccgggaggcagagtttgcagttggccgagatcacgccactgcactccagcctgggcgacagagcgagactccgtctcaaaaaaaaaaaaaaagattcttggaggaagggggcctgggagctatgtcagacaggtagtagcagctctgtgtggctgactctccactggccctagcatttccctaaacaattggaagtaggagggtcttgagaaggggatccccctctgtgaagccccagcaccatccaaggtcagcaggggcctcgttcccatgcccagaggcagggtgagataaggggctcaggtctggctgtcccaggctgctcctggggcccagccagagggggcagaggagccgaggggggagttgggggggatctggcagtcccagccctgcaggaagtgtttgtgcatccgccccggcggaacctggctcccaatccccgactgtgagaccgcctgttcttccttccagtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 368 - DNA, 13733 bp, Homo sapiens
  source 1..13733: mol_type = genomic DNA
ggggaacctccctgaagagtgccctggtcacagcacccttgaagacagccattggccatgggtcagtgttgagtttggttggccctgtgacgcgctggagctctctttccagtgcggtatccttggccctggtgggtggagggggtctcaggcttgtgtgtggatgatgctggagcgaggaagggagttttgctctggagaagtgagaaggcctggctgtctccccggttgctggatgaagccacttgttgctgggggaaaccagtcagggctgcttgggcctctgggcctctgagcctctgagcccaccaggcctctgcgccccctggagagagaaggagggaggagggaggttcagcaactggactgcactgactcacaggagagctgggggcagggtggctgagcctggggaaaggccgatttcggaggcgattaaaaatatttgtacaactgattccagggaagtgaagcaaaaggcccttttgtccagaaaataatctgaggctggagctgggcttcagctgtggggtgggggagactcagggcggaaggaggttcccctcctacccccctccttgaaccctctgagaatctttaagcagaagatgcaactccaacatggaggggacaaccctgggtgtggagaaatgcacctgggaccatccagaggtgacttccaaatgcccactgtgttcaggcacagcaccagctgtggcagtggattctagaagtcttgttcaccagcttcaaagaccttacagccctggaggggagacacggacatgatttgaacgttcagggatcagaaggctcagtcttagtgcagggtctggggacccacaggaggcagaagtttcctccagggtcctgaggaaaagcctctgaccagagctgagtccatcttgtcagtcccttagccaccatcttaaaaggtggcattgggccgggaacggtggctcacacttgtaatcccagcactttgagaggctgaggtaggtggatcaccttaggtcaggagtttgagaccagcctggccaacatagtgaaaccctgtctctactaaaaatacaaaaattagttgggcatggtggtgggcacctgtaatcccagctactcgggaggctgaggcaggagaattgcttgaacctgggagttggaggttgcagtgagccgagatcatgccattgcactccagtctgggcaacaagagtgaagcttcgtctcaagaaaaaaaaaaaggctgggcgcagtggctcacgcctgtaatcccagcactttgggaggccgaagcgggcggatcacgaggtcaggagattgagaccatcctagctaacacggtgaaaccccgtctctactaaaaatagaaaaaattagccgggcgtggtggcgggcgcctgtagtcccagctactcgggaggctgaggcaggagaatggcatgaacctgggaggcggagcttgcagtgagccgagatcacgccactgcgctccagcctgggcgacagagcgagactccgtctcaaaaaaagaaaaaaaaaaggcattggctgaatgtgcactcccggcatcagagggctggagctgtgctcttctgagcttctctttaactctctgagggtccctgtcctaggcagtggatgagagccacgcccagaaagcccaggtttcccacctgagtccatgtatttctgtcttcccacctgcccttccatttctgggggaaccagagaaataagatatttcaggatgggaccaggttgtttcctctgaggctgttaagttactcagcaacttactaaaagcagcagcctggctgctgggcagcagcatggtacctggatgcggtgaggggcaggtacaggctcctctctcattccttgaaagtttctatattgagggggttggcaggagaagcaagacttgaagggtcaggtgcagaaggaagttgctggtcaccaaccacaaaatcagggggaaactggaggtgggggcttagggacagagagctgtgaagctttcctgaccctagcccaagtgcctgtgggcttcttggagccagcagggtacaggcaagtatttctagggcaagatggatcaagaagaatgagtgacattggtccctggcttggttttctgtaatgacatgcctgttagatttgaacttgtagtatgggctttagtatccttttcccccacctccgccatccaaccagtccttcgattgttttttggaaaggatctttcagagctggccattatggctttacctttggccttgacctttaaactggaatgaatgtgccccccaacaaatcgattgcctgtgcatttttgccagactcttttcctaaaagcgcaaccctggctatgcccccatgatgctaaaagcagccttcagtggctgcctgttgcctttaggataatgcccccagccccacccctgtagcatttccaatgtgtcagccagcagctgcagcctccctttgcagactcagctgatacttggcaaactgaattcttttttaacttgctctggacttgggctcaaagggctttgattcacaccatcttttctgccttgcacgtccctctccttgttcccttcacctgctcagtccttcctcacattcttcagggcttagcttttgggtgtccctgtctcttggcagtgtctgggacctggtatgtttttttattagattctgagtaaaactctgcggaacagtctttctctactctgcctgtttctcttctgtgttcctgtagcccctgtctctctcctgcaggtaaattccgttgtgtggcccttaatcatattcttccttgtgtaatttttgtgagtacctaccttatctctcttgatagattttaaatgccatcaagtcagggactacgtttgttcatgtttgtattttccacagctctgggaacaacagggcctttccttcccaggcgcacagtcaatatttgctgatttggagtaattgcctgttctaaactgggccctggccgagggaggtggggtgaaaagcccttgaaagtgcaggtgtccggagtctaagtggcagttctgagggttctcttccctacgtccagcttcaagcccaagttctggctggtttggctgtggagcccaagatgaagttgaacatttaggatcccacagcttgttgttatccataaattatctcccaggagtgggtccatattacgccttcccttttttgttgttgttgttgttgtcgttgttgtttttggtttttgagatggagtctcgctccgtcacccaggctggagtgcagtggcgcaatctcggctcactgcaatcttctgcctcccaggttcaagggattcttctgcctcagcctcctgagtagctgggattacaggcgcacgccaccacacctggctaatttttgtatttttagtagagacgtggtttcagcatgttggtcaggctggtctggaactcctgacctcgtgatctgcccgccaaaagtgctgggattacagcatgagccaccgcacccagcctactccttacctcttagccctctcttactcctctttccagcacttgtaaataaaatgcagttggtgctttattgatttacaaagtcccctacagaagcttatttaagtcctgcattagaagtaaagagaaactagccattagaacgccagttatttaggaaaacaacagtacatttacatgagatagttaattttaagagttaatcttaagcaagcttaattgaaagatgaggtagctgagatggctaagacgacctaaatattttcaagtggcatggagactatttgaagggactttgaaaatggatcctctttattgtgtccatttcacttaattttatgagttgcattgcccctgatttagtaagtgttctttcacataacaattatggacagaatttttttttttttttgcttctgtgttgaaaagagggacaatttctatcaactgtgggatttagggcttttgtttgcctattagaaattaagtagccaggaatggtagaaaacagtaaggaggtaaaccatgtataaacaacctcacaatccccctaaaaaaggaaaaagggtggcagcctcacagaagagagttagataatgccattcccctgccagccactagtggtcactgtcagaccaggaaagcttggttgctgttttcccagagagttcctgatgaagctgggttacaactagttatttgaacacgtggggtgacttaaatgtggactacctgcattcatagaattttgaaacgtataacctgtttctttaagcatttaaattttctttttcttttcttttcttttctttcttttttttggaaacagtctcgctctgttgcccaggctgcagtgcagtggtgcaatcgcagctcactgcagcctcgatcccctgggctcagatgatcctctaacctcagcctcccaagtagctcagactacaggtgcatgccaccacactctctgctaattcatatatatatatatatatatatatatatatatatatatatatatatttgttgttgttgttgttgtttgttttcatacagagtctcactctattgatcaggttggagtgcagtggcgcagtcttggctcactgcaacttccacctcccgggctcaagcaattctcctgcctcagcctcctgaatagctggtattataggcgtgcacctccacgcccggctaatttttgtatttttagtagagacggggtttcaccattttggccgggctggtctcgaactcctgacctcaagtgatccaccagtcttggcctcccaaagtgctgggattacaggcgtgagccactgcacccagctgctaatttttgtgttttttatagagacggggtttcaccatgttgcccaggctggtctcaaactcctggactctagcaatctgttcaccttgacctcccaaagtgctgggattataggcatgaaccaccgtgcccagcagcatttaaattttcagtgttaggtttcctccaagtacatttaaaacttttgattggaaaaaaactcattgatttggtctttaatatttcttaacctgttaaatccattacctccacttcacgtgggaaaatccaattggtattgggagcaggagtttggttttcttctctggcacagatctgtggcatttggtagagcggcagtcagtagatggagtgaaaattaccttgctggtgttaataaaagctaattttcttgccttctagctacaacgtcttaaagtcttctattaaagattaattcctttgggttttgcattgcccttgcctggttcttacttttaaaatgttaatgctccgaaggaaaatttttgcattaagtcattaactccttagctggggacttcgtttatttcacccttgacttccgcttccgagctaggcaaaaaatggaggattctgaactggagacttggcactaaaagtgggaaaatgactgtctcttcatttttcctggctgttggttatgcctgctgcagctgcttgttaagtctattgaatgaatgaatgaacacatagctgactggctgtggatttaggcctcacaggaatggagtttaggggcatagcagctgacctcctgaagcctgaaagtcccagggcagagaggaggtactgggtgggtggtatgcttggtcttgacttgttcacaagccccttcatcctccaccgtggccgccagagctcagggaatatctgaacccaggttatgtttggtggaagggagggaactgaaaattcaatgacaggtttttcttttgccatggctaggaatagggctgacaaatgggcttcatctcatttgcctctgtggccagttgaaatgcctctcaggggttctatgttaagaaggattctgaggtccagagagcctcacggtcagcagctagcactatctgcctgggtttaggttgggggaagcagcaccatgtatattggagtctgatcttggaggactaattttgtcccttttccttctgtctctagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcaggtgggtctctgtggatgcccccagtggcccctttctccatcccatgtcttttactgcaggacagggagccagtctcttgagcaaaatggaaagtttttgaggttttctgtagttttctgcctaagtgtctctaaattccatttaatttaaagatttttttttttcagttgggcatggtagatcatgcctgtaatcctagcactttgggaggccaaggcgggtggatcacttgagacgaggagttcgagaccagcctgatccacatggtgaaaccccgtctctactagaaatccaaaaaaattagctgggtgtgctggctcatgcctgtgatctcagctactcgggaggctgaggcgggagaatcacttgaacctgggaggcggaggttgcagtgagccaaaatcgagccactacactccagcctgggtgacagagcaagactccatctcaaaataaataaataaataagattttttttctatattcatataattcatgcatacattctcactgtaaaatttcaaacattacagataaaatgaaattttccccagctgcctccccagtcctacccgtcccatcctgttccatccccagaagtgaccactattgactgatataatatctatgtgcctttgtttctccatttgtaaaatggggataatgtcagtacctatttcatagggttcttgtgaggattgaattaattagtgccggctgggcgccatggctcacacctgtaatcccagcactttgggaggctgaggtgagtggagcttgagcctaggagtttgagaccggcctggacaacatagtgaggccccgtctctacaaataatttcaaaaattagccaggtgtggtagtgcatgcctatggtcccagctcctcaggaggctgaggcaggaggattgcctgagcccaggaggttgaggcttcagtgagccgtgattgcaccaccacattccagcctggatgatctcaaaaaaaaaaaaaattacttagtgcccggcccatgaaaagcactcttgaagaattagctatttgctgtgtgtgcgtgtctattattttacatattttactaatactatccttccagaacttgtttttctattatgtatgtatccataatcaccttagttttctttaaaaggaagtatttttcaggtaatttttttctctttttttattttttgagacggagtctcgctctgtcacccaggctggagtacagtggtgtgatcttggctcactgcaacctccgcctcccgggctcaagagattctcctgcctcagcctcccaagtagctgggattacaggcacgtgccaccacacctggctaatttttgtatttttaatagagacgggatttcactatgttggccaggctggtctcgaactgctaacctcaagtgatccgcctgcctcggcatcccaaagtgctgggattacaggtgtgagccactgcacctggcctttttctctttttaataaaagtatttggggtgccgtgtagtggtctcagcagcgcccttgttagctgtacagcccactagcatttcctcagcacctgctctgtgccagcccctgtgctaatccccttaccgatgtggcccattgcacgcatcccacctgctcttcctcagcctgctggctgcagcccctcatctgacatgacctggaaatttgggggtgccatctcaaagtcctgaccctgcccccagactgtgctgatctggaggcctgggggcttcagactttcttaactgcccggttaacaagcaccggctctggggtctctgctgggaggtcagagtcaggcagtggaagttccagaatcagagacattcctttctcttctacacactgtgaaatcctcataatccctgctttggagaaagagatgacccttgtcctgccgggcacttgatctttgatctgcccacctgggctgaggtgctggcctcacccctgggtggcccctgtcacacgcacggtgtgcatggcgggggtggaattggcaaaacccaccagagaggtggggcttacagacaagtgctgggaggagcctcaggccccgcccccacactgaatgccggtcggggccaaatggttctcaaccttggggctgagtttttacttcctttttttttttctaaatggaaaaatcaatagagtgagcccagccccagcacttaggaaactctatataggttgcggtccctcagaactgcagggccgtcagccttgccggagccagacgtccgctgtgccgtcctcacagcaaggcctgctccgaggccccggggtgcgtcagcagccctcctcaaacaccctgggagtgcccagcagggcggaacacaccgggaaaccaacaccccaaaggcacaaggaagtatccctggagctaaaaatagttctggaaacttgccagggggccacaggctgggacgtgcgttaaggctccctggccaggctctgggttggtgtagtggggaaggggcgcccaggtcggccctgggaggacatgaacaggcttaggccgagggctctcagatgtatttacctctgtgcctggcagctggcccgtggtgacaggcagagctggaggctggccatcttggaaggcggccgaaggcccatgtgtcctcttggcctctggccccggagggcggatggggatgtggaagttgctgacagagcattttctgagctgttgggtcaggggctggggtgtctacagtgcagggaagctcagcagtgttgttcactcccatgcatctgtacaaaggggtgctaggcttgggagggggcccccgtgttcacaacctcacccccaagttggccactcctgggttagagactatgccagggttggcctgccccctttacctcttccctgcccccagagagccttgcttggtttgtgggaggtggggaagggagctgagagccctgggatcttcaaactgttcctgcttttccttgtagctaagaggccggtgtcaccatacagcgggtacaatgggcagctgctgaccagtgtgtaccagcccactgagatggccctgatgcacaaagttccggtaagtgggttccccaggtccccgtgacacgtctgggctacagagaccagcctcagcaggccagtgggagaaggccatgtggccagagctgggttgggtggaggtggtaaggggaaggcaagcttctccatctggtgcttttacctggggaatccagagccccagttcttaaattccttgtcctggagtcagtgtacccaccaccttcagctgcactgcagtgggacccgccctgtgtcactggggcattgcacacaggttgtgtcgggatgctatagggaatgctgggtgagctctccctggtgggagctgccagctttaccctggagggcttggggagggacaaaggagggtctcagccaggtgctcccaaaatagacaggggtccaaatgtcacaggtctggataggtgtttacttctcaaccacagctgtgccaagggggcccacactctcctccctctctggcaggcagcaagtctcgaccttacacctccccctgggttctggaaactagaagcatcgttagccaggggagggggagggagcaggaagacggtgggttggattctactcactcctatatgtgttcctcctcccggctggcagaggctgtggggagaggtcagtgacccgtcttggcaggacactgggaacaggaaacaaggaggtcagctgggtggcgttctcatccccctccccgccctctctgtgagagccgcggggcagggggaggtgagtgtggctgaagcttccaatcccagcgcctcccctctccctgagcctgaacctgagcctgggcagaggagagcttccggagcaccaggagtggaggctgcgggctgtcagctctggcggggagtgggcagccacagaagcctttgctgaatagcttccttcactgttgctgcacctcactccccagcgcgtttggagtctgcttcctgggggatgatctggattaacagggatattttatctgaccggttctcaaaacatggtacccggaccaccagcactagcctcacctgggagcctgctcaaagtgcaaatgggggccaggcacaatggctcacacctgtaatcccagtactttgagaggctgaggcaggtggatcacctgaggtcaggagtttgagaccagcctggccaacatgctgaaacctcatctctactaaaaacacaaaaatcagccaggcatagtggcacatgcctgtagtcccagctactaggaaggccttagccagaggatcccttgaacccgggaggtggaggttgcagtgagcacagactgtaccactgcactccagcctggacaacagagtgagactctgtctccaaaaataaataaataagaaaaaaaaaaaaaagtgcagatggggcggggccagagctgggatggagctgactgttagcatccgttcagggcgtcggcaccatgggggcactatccagcgcagatctgcaagcccagcattcagcactccctcccccagccccagctgttgccagctgcatggggccagctgtgttgggtggggactgtgtagggtccagctatgagttggtggagtctgcgtggggactgtgtagggtccagctatgagttggtgaggcttaacaagcagtgcaggtgattccaatgcacactcatctgtggttttggaccacagatgtagatgttccagggaccacatggacaggggccattgcagacaggcctgaggacctcctgggcctgattgacttgaaggctagtttggggtctgggagctacagagatttggtggcagctctttcccatagggctaagacagatggggccaggaatacacctttcctccagcataggagccggaacaggtacctcaggaccctcttcaccccacagctggtgtctctcacccacatgggagcaagacccagcgccaggcagagaattcaggtttcaagactccaaatcagggctggttgcagtggctcatgcctttaatcccagtgctctgggagactgacatgggagaactgcttgaggccgagggttcgagagcagccctggcaacgtagtgagaccccccccccccgcccaccatctctacaaaaaaaaaaaaaagactccaaatcagaccggccagactagatgcctagagagatgtgtgggcacacccagagccatgtcctccgccagggaagccagcaactgtgatgctgggggtatggtagtgacaggcggtcgactcggggtaatattcttggaggagccgggcatggtggctcacacctataatcccggcactttgggaagccgaggcgggtggatcacgaggtcaggagattgagaccatcctggctaacatgatgaaacaccgtctctaataaaaatacaaaaaattagccgggcacggtggcgggctcctgtagtcccagctactcgggaggctgaggcaggagaatggcgtgaacccgggaggcagagtttgcagttggccgagatcacgccactgcactccagcctgggcgacagagcgagactccgtctcaaaaaaaaaaaaaaagattcttggaggaagggggcctgggagctatgtcagacaggtagtagcagctctgtgtggctgactctccactggccctagcatttccctaaacaattggaagtaggagggtcttgagaaggggatccccctctgtgaagccccagcaccatccaaggtcagcaggggcctcgttcccatgcccagaggcagggtgagataaggggctcaggtctggctgtcccaggctgctcctggggcccagccagagggggcagaggagccgaggggggagttgggggggatctggcagtcccagccctgcaggaagtgtttgtgcatccgccccggcggaacctggctcccaatccccgactgtgagaccgcctgttcttccttccagtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 369 - DNA, 18416 bp, Homo sapiens
  source 1..18416: mol_type = genomic DNA
cggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggtgagagtttcccttcccgggaaagtctgcggcagggagggagggtgcgaggggcagggccgcagggcaggtatcacacgagacgccccgagtctggactccgtgcagaacgcagaatgcggtgcgctctgtctaccacataagatggacagatgaaggtccacacccctgggagaggaaggagccagggcctctcccggctctgcacccacgtaccttggctgaaccacagcggggcaagtgataaggggtgggtgcagaaaagggaccttttaggttttcagttgaattcttacaggaagggggacgagaggcaggatgtgtcagggtgggtggagagtggcagccactgactgcgaggggcatgtggtgagggtgggggagatgccgggctcactgggtgcagggtatggaggaggggggtgtggggagggtgggggagatgccggcctcactaggtgcagggtacggaggagggggtggggcggtgagggagatagggtcggggtggggagcagatcgatagtctctggaatgcggagatttaaccagggcagcccagcggctggggcctgagcagggggaagtcccgaggcagccttggctggggttagcccctgcatgggcctgagaaccaggggtcagtcctctccaagaaggggatatgggacagaggggacagaaaaggtggtggggagggcgaggagggaaaagatcgggcagagaagcgctgagatcttctttagggagaagcgtggagttgagtcttccctgtccaagcgcagggattcctcccgcagagtcacctgctgtgccttcagtcacgtccaccgctctcctcagacagctcctgtgcagactcctcaggcctagtcctagggtattgtacgtctttgtggttgctttccttacagatcggaggttttctgcaattatatttgctaactacttgtctgtgggaaggttattacttttggtgtcttgacttggaaacgggtcatcctcccataacaggtgctcctgcgattctcttgggtgttcttctgtttcatagggtcggtgtgcatgggaaggtttcagttcctgtctaatatctgtttctctttctcccattgactcattggctggtacagccggagtgaggcccagcggacatagtggtagtggttgtccctgccttgttgctgactcagggaaaaaggaccagagcttctcattattaggaagaagggatccaccaatgactattcacaaagcatttttacttttatttatttatttatttatttatttatttatttattttttgagatggagttttgctcttgttgcccaggctggagtgcagtggcgcgatcttggctcactgcaacctacgcctcccaggttcaagtgattctcctgcctcagcctcccgagtagctgagattacaggcatgtaccaccatgcctggttaattttgtatttttagtagagatgggctttctccatgttggtcaggctggtctcaaactcccaacctcaggtgatccactcaccttggcctcccaaagtgctgggattgcaggcgtgagccaccaagcctggccaacatttttatttttttgagacagggtctccctccgtcacccaaactggagtgcggtggtgcaatcacggttcactgtagcctccacctcccgggctcaagtgatcctcccacctcaacctccccagtagctgagactacaggtgtgtgccaccacacccagctggattcttaattttttttagggacagggtcttaccatgttgcccaggctggcctccacctcctgggatcaagggatcctcccatcttgtcctcccaaaatgcagggattacaggcatgaaccaccacacctggcccctacaaaacattttttattttatttttatttatttttttggagacagaatctcactctatcacccagggctggagtgcagtggcttgatctcagctcactgcaacctccgcctcccgggttcaagtgattctcctgcctcagcctcttgaataactgggcttacaggcacccaccaccactgctggctaatttttttgtattttagtagagacggggtttcaccatgttgcccaaggtggtctcgaactcctgagctcaggcaatctgccagccttggcctccggcccccacaaaataccatttttattatttatagaaattattattattattatcctttcagctatgaaggaggtgaactacattaggagatctggtcagatgtttgtcttgatttattatgctggcttcatggaaagaattagggagatctccctgtttccgtgttctctgcaaatgtttacataaaattgaaattatttgttccttgaagtttttagagaactagcttgtaaaactgtctgagttttgcttctttttttttgatggaagggaaagaatttcttaataacactcatcatttttggtctacattaaaaaaaatctagctgggtgcagtggctcacacctgtaatcccagaattttaggaggttgaggtgggaggatagcttaagcccaggagtccgagactggcctgggcagtatagcaagcaagaccccgtctcttaaaaaaaaaaaaagtctattcttggcctacattgatgatttatattttcctaaaaaatcatcagtgtcgcccaggtttgcagacttatttgcagagatttgcaaatttttcttttgaattttatatctgcgtcttctttatttttggtctgactacctactagtctaattaattgtttgaggccaggcacgttggctcacgcctgtaatcccagcactttgggaggccaaggcgggtggatcacttgaggtcaggagtttgagaccagcctggccaacatggtgaaaccccgtgtctcctaaaaacacaaaattagccaggcatggtagtgtgcaccctgtagtcccagccactcgggaggctgagacatgagagtcacttgaacccaggaggcggaggttgcagtgagccgagatcatgccactgagctctggcctgggcgacaagagcgaaactctgtctcaaaaaaatgaaataaaataattaatcatttaccccttacaaaaaaatccatttattaatgtatatactaactccactgtttttctgtttcttaattcactgatttctgtgaattcaccagttcgtgaaagatgacctggttctttctgtgttgtgtgtgggtgtgtgtgttcctcttctgacctcttgagttggacaattcagtcatttacctgagagttaatgggtcaagattctgtgatcttcaaggaaaacgttaagacgacagaggaatatcctggtagaggaccctggccccaaggtggtccccagtctcctgtttatgattagaggggtttggggtggtgattcaggttggaagagagaaagcgcagaaacacaagcctgggagcactggggatccatgtgatcgttccaggtaagtggggaagtaaatggagggttttctgacacttcgcaatctctaaattataatgacaccctcacaggtggaacagagctttggggagatgattgggtgacagttttttatccaagatttcagagaagagaagttaatcaggagagagagaaagagagagagctagagggagagagagagagggagaaagaaactaaatccgaagggaagtcagacactggaggtaggacgagagacaggattgggtgcagtgggcagaggtggtggggtcactgaggtcaggagagaagccaaaacatggacaaagaaagatgacgattcgcagcccaggagaggcagggaatcgggtcaggacagggagcaggaacagtgtcttgggtgaaggagggctgggaactgacagtttttatttattttttttgagatagagtctcactctgtcgcccaggctggagtgcagtggtgtgatcacagctcactgcaacctccacctcctggactcaagtgatcctcccgcctcagcctcctgagtagctgggaatacaggcacgtgccaccatgcctggctaattttttgtgtttttggtagagatgggggtctcaccacattgcccaggctggcctcaaatgcctaaggctcaagcaatcctcccactttggcctcccaaagtgctaggattacaggcatgagccactgcacctggcctatttatttatttgagtcagggtctcactctgtcacccaggctgaagtgcagtgatgcgatcatagctcactgcagccacaacctcctgggctaaaatgatcctcccacctcagcctcctgagtagctgggaccacacgtgtgcaccagcacacctggctaatttttgtatttttttgtagagatggaatctcactatgttgcccaggctccatttacttattaagtacttaatatgtgtcaattttagtgatttgtgtttttctagaaaataactttcatctaagtttatgaattttatgtagagaatttctgcaaaatatcttgactcttcattctttcttcatctatggtccttttctcttgtcatgtcttatttagtcagcccagaggttatctatttttattagctggagtcatgtgaaaccctgttgtcttggtcaaaaagtttaatatcagccatttcatgtgattcaacctaatgttatttaccaggcattttatacctgtgatctcatttaacaccctcaaaggccatatgagtcagggacaattgtcaccactctatagacaaggtgtctgaagctcagagaggttaactaacttgccccagaacacacagctgatacgtaatagggtagagatgtaaacgcagatggttctgaggatctttctgctttgtcctggcaattgctgctgagagcctcaggaagcatcacacctgtgacaagcttagaaaggccttctctgcagggggatgtgtacatccaggcgtggagaggtttgggtgggactctgggagaggcacagaggagcttatctttgggcagccgtgggctgggtgtggagctagtggggtccaggagaagcttgcactgaagtttttgtagagggcctacaggtgcaaggcacctgtagacgttgaaggtataagaaggagacccctaccaaagtctcatgtgtgaggagatttagcatctgaaacagtaagtaaaattaaagagttctggccaggcgcagtagctcatgcctgtaatcccagcactttgggaggccgaggcaggtggatcacctgaggtcaggagttcgagaccagccaggccaacatggtgaaaccctgtctctactaaaaacacaaaaattatccgggtgtggtggacgcctgtaatcctagctactcggtaggctgaggcaggagaatcgcttgaacccgggaggcagaggttgcaatgagccgagatcccgccactgcactccagcctgggcaacagagcaagactccatctcaaaaaaaaaaaaaaatcaaagagttctaacccaaggaaagaagagcaagcccccatccccaccatccttgaacaatatggggcctaatcacagaattacaagggcattgagacactgcacacacaactgcccagcaggcctgtgcccatctgcctggggcaggggccatgtgtcctctgcttggcagccaacactagcttcgagccatcaccttactctccttgctttgcatctgataattatttgggaaaatgtcagacataattttcaaggaagttcatttatttccgagatttaagtctaggagagctgggcaaactaaggtaagacacaggatgaaagttttcgtcagcaagccttctgcgtttgtgactctttttttttttttttgagacagagtctcaccctgtcactcaggctggagtgcagtggtgccatctcagctcaacataacctccgcctccagggttgaagcgattcttgtgcctcagcctccccagtagctgcaattacaggcgcatgccaccacgcccagctaatttttgtatttttagtagagacagggtttcaccatgtcggccaggctagtctcgaactcctggcctcaagtgatccacccaccttagcctcccaaagtgctgggattacaggcataacccactgtacccagccagtattcttgtcaaaatggcttgacaaccctattactgcccgggtttgccccttggtgggaccagatcagtgtgtgggccggtcttcctcttgcagggttgcccagggctggggtggccctcccgggagtgcaggtgcttaggggtgagttctcatgctcctggcaggtttggaagcaggaggcccctggtgggtgagaggggtgggaagggtaagggaaaggaggcagggggctggagaaaggggctactatgagcaaaatcttgagggtggtagagcagaaaagagaatactcaagctgtgatctggctgatggggctgatatgaggtgaaggagtcaggggctgagggctgggggtgctgatgtggagtcggggaatctttggaggaggtgactccagggcacccagcctgagctcttccggtctccatggaaagcctctgccccattcccacctgtgtgcggaggtagcctctcatcctcagtccccgctcctgggtggacaaggcctctctgcctgccgctgcctcctccacacccccagggtccatgcggccctgaccccagggcacccctgaccaggctcatctgaggaggagctgggactctggcttgtgttttccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccgggtgagcccctccttccctcagcgcctaaataggctcaggttggaattgttggggcaggaatcagatcagagacgtgaagcagacagtgtgtgtgtgtgtgtgcgtaagagagagagaggtgggggccaggggaacacagtcagggggtctctcctggagcagctgacatgtctgcccagtattgaagaagggaagggtccagtgacagggaggctgagagagcgttgcctgtgaaggagccaggagcgcacctgtggctcagccccaacggaagtgcagctgagtgggggaggggtggggctgaacagagaggctggggggccagatgggaagctgctgtcctcagggggagccttaccacatgacaggtcagatttgcagtgtagacagactcctctgcagcatggagtttcgcaggagcacctggaccctcatcagcaggatggaaaatcaggaccactgggagtggcacccgtgtcctgttcagaaatgcccagttggcccaggagggtcctggagagactctagccccagggtcctgcatcctgcccccttccttagtgggcagtttgtgtgaaatcaaaccaaaaaggcatcctgagtggtgggagagccagaggacagctccctgggtctgacttgtggttttgccaccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagtaagcaccctagcccctgagacatggagggggccctgtgctaagaggaggagcccagggcggggaccttggccatgtgggccagctggaggtgtgcatcgctccctttgccccaggcccaggttggaagccatagtctgaacaccccggcttggacctgcccttggctttggaagggggctcaggtaggggggaagttggggggcagatggaaggaaagtgatagttactgacagctggtaacatcctacgaggcccgtgttagatgcttcacatgagtattctcacttgcctttcactgcagccctgtactgttgtcattccgtgtattagtctgttttcgcaccgttgataaagacatacccgagactggataaattataatgagaaagaggttttaatgtactcacagttccacatggctgaggaggcctcacaatcaaggcagaaggcaaaaggcatgtcttacatggcagcaggcaagacagagaatgagaaccaagcaaaaggggtttcctcttataaagccatcagacctcgtgagacttattcactaccacaagaacagtatggagcaaaccacccccatgattcagttatctcccactgggtccctcccacaacacgtgggaattatatgggagctacaattcaagatgagatttgggtggggacccagccaacccacatcaatccccattttacagatgagtaaactgagactcagcgaggtgaagcaatttgcccagtcaagtagctacaagaggctaaggctaagcttccaattctggtttatgtgactccagagccttgagttctcctctctaaatagtggttcttaacctttttcgggttcaccaaccccacatagaatctgacatctatggacactctccccagaaaaacacatgcagtcacaaaccttttctgggattcacggactccctattctagcacaaaaccccacaattccatcctggcactatccacccagagttagtgcagaccccacaggtgaagagcttccacatctaaatcagatcccacaagaccgccctgatttagatgccagtcgaactttggggatccccaggccaccacacttctgaccaactggatgcaaatttgggggttcccaggacccccccaggttcaataatttgttagactcagaactctggaaagcattatacttacaattacagttttatcataaggataaaggataaagattaggaccagccaatgcagagacacataggacaaggcttgggaggattcccaaacagtttctgtgccctctccaggtggaatcagggagcatcacctgcaccctccctgcggcacctcaatatatttatcaaccaggaagctcctccaagctttggtgtccagagtttttattggggtttcattacataggcatgatgtgattgaactgtctccacctccagtccctctttgggaggttgggctggctcagggctccaaatctctaattacgtagttggtctttctggtgaccagccccatcctattgtctcatctcttaccaaagtccaggtgtgattcatgaacaacaaagacactcctaatttttgggacattccaaggatttagagcctccctcctaagagctagggacaaaggccagccagattctttactggacaacatccataaacccctccacaggcttctgccaacatataagacaaggcaaaattcaggcttgaacatgccacttccagaagtttagcctgtagatacacataggtggcagcgctgagttctgtggggcctgaaggttgtgcagtttgcggggtgggttggtgggtgggtaatctaagaaaaagatgagaaaattatgaatgcaaacgtaggcatgaaggaaagggcccaagcaatggagggacctgaagctgggctgcatcagcctcctggtcaatctgctgctgcgtggtcaggtgtgaaaaggtggagctgcaaggcgatttataagcaacgtttaccattgcaaaggactggggaaatgcccattcagtgggaacatttaaataaatcacagtctatccatgtgttggaataccctgcagctataggaaagagtgagggacttctttatgtactgacgtggaaagacctctaagatgtattgctaagtaaaaccagaatagtgttagacgaggcctcctttgtgtgaaagagaaaggagatcccgtacattcgtatttgcttgtatacacataaagaaactctggaaggttcttaagaacagcacgtgtgtgtatgtggggaaattggggaatgtgtaaatggggggtgtgtagaaagggggctttatactgtctattttttttaattgaccttatctatctacttaaaaagttagagaaggagaccaggtatattggctcatgcctgtcatcccagcattttgggaggctgaggcaggagggtggcttgagctcaggagtctgagaccatcctgggcaatatagcaagattgagtctctacgaaaaatttaaaaattagccgtggtggcctgtgcctgtagctggaggctgaggcaggaggatcacttgagcccaggggttcaaggctgcagtgagccatgatcaccactgcactccagcctgggtaacagagccagatcctgtctcaaaaaataaaaataaaaaataaaaataaaaaagtaagttggagaaggcaagttggccccgcccttaccatcctgtgcctcctccaggctcccgctgctcctctccctgctggcattgttgctgcttctgttggtgggggcctccctgctagcctggaggatgtttcagaaatggatcaaaggtgagttggctccccacacccctctgccccacctggggtggtcagaccctgaccacagacgctcatcttcaaagctatgtccacgtcccacagtattgctatgacatgtgacacccagaccacacatcctaggtgatcctacagggcaggtcccatgggaggcatccttgtgcgtggtggttacaggctgtgagaggtggctcccaagcaggaggctttcccacttccaggccaagggtggttgccccatgaagcaatgaccctcttctgtttaaaaccctggcatggtgtgctgggtgcagtggtgtgcatctgtagttccagctactcaggaggctgagatgggaggattgcttgatcccaggaattcaagaccagcctgcgcaacacaacaaggctcccgtgtctataagataaaataaacccttgcatggtctcccccaccataaaaagtccaggtatctacaggagtcactgccctccacgatctggctctacccacctccctctccccatccgcgcaccctggaaaccaacttcttgtatctcctttaatgacagcctcaacctcagcctctcctctccttctgggtttgctctgggctggagggcctcccctgccccctctccccagctcactcccagtggactccaacagtggtcctcagactttcttttctctgggaccttttctttgactccaaagagtggcttggggcccctcctggctatacctctgctgtcacagccttttgggaaccagactgtcattgctggtgtcctcatctgccttcccacaggcatgtgcttcaaggaggtacagaaccaatatttgtcaaattaatgtgttattcagtatctccagctgcaacgggcaccccaggggcctccaggcaatctctagtccagctgccctcctctgagctcagattaaaagagagaacaggaactcttggcactcagtaagtagatgctcaataaatagctgataggcaaattgaataagcacaggaacagaggaacaagtggaggtgtggccaccagtcctctagattgcagatccctggccgaggtcaagtgtaagcctgaagcttcctccctgttcggagagttgaagattccacaggcagaagattctcaggggaatctttgtccaaagccttccaagactgcagtgagactggggtgggaagagatggggttatcctgtcccatagctgcaggataagctgctgcatgcttggtggggggcactgctcacacatatccccagtgcctcctgtggcgcccaggcttttggcggagaaatcagcctcagtagatctgtgcagggtgtatgggaagaaaaccacttcctctttcccatctgctttgtgtgtgtcattttctggtaatcccatcctaaacttcagcacccacgtggatgccactgggttgtctcagttctgagcccctttcggtttcctttgtgccctttcacccagaaagtctctggctcctcaaagagcctcctccccccttgaaaaggatgtatgtgattattgtaggaagtttgaaaaatgagcaaaagcacaaagaaggaaataaatcccccatcatcgatgataactaaaaaccccaccacctagagaaaaccagccactggcccctgaggtatatccttccagtctttttttctatgcctatgtaaatgcatctatgatttctttttttttctcttttttgagacagagtctcactctgtcacccaggctggcgtgcagtggcatgatcttggctcactccagcctcgaccccccactgcccggggctccagtgatcctcctgccttagcctcccaaatagctgggactacaggtgctcaccaccacgtctggctaatggttaaatttttttttttaagagatggggtttcactatgttgcccagcctggtcttgaactcctgagctcaagcccagagtgctgggattacagatgtgagccaccacacccagtcatgcatctgcgatgtcttaacaaattggcctcataccactcattctcttttaaacctacatttttgcacttaacatatggtaccatgttcccagctagtaaatgttctaaaaatcacagacgcagagtttactggtgtcttaagcttcctgtaacccatcctcagtaacaagataaaggctttctattcaaacatttttgactctctgtcccctgctttgcaagtccgtgccccatcccctgactgtgtggctggggctgacttccccttgccctgcctggagcctgacacctgcctcatcacacctactccccactctttcccccagcccacatttgtcgttcattcattcgtacaacaaagctgtcctgagcacctactgtgtgccaggcctgtgctgggccctggggacaacattgtgactggggtagactgggtcttaccttcagtgagcttcccctaccgctggctcccccaaaccttctcactaccaccctccttcccgggcgttgaactcctgtctcttccccaccagctctttttctccttcccatcagaacacttgtcccaggtggggacagggagggcagtgtggtgcctgcgcacagcacttggaagcagggcacttcgcaccccagagtacccggctgcgcactccattaggtcagctgtggctcagcaagcccgtcactatacgtggtcttgtgtctcccaaccgtgggctcctcccctttaattctgggggaggagcccacagatccccacagcatccagtgcagtgggctctggggttgcctggctgtggacctaaccaagggcatcagcagcgtgtgtgtcacccgctgcccacgtggtccgggctcctggggtgaaagggttagggtgtacagggctgtgctcataggcagcacccttatagagcaggtgccagcagccaagggctgtgtgagcctgagctggcgtccctggggctgacaggcctccttccctacggcctggggcagcaggcaggtgggctgtctgggagggcagacctcaggcacggggatgggagcagaggccccagcaacttcccacagtctgatgcagccctaagccccagatgcacagggcttttcagtggcatccttcctcccctggaaacatttgtgtgagatcccgtgttgagagcttgttttggtccctctcctccagctgggagctttctttcctttctttctttctttttttcgtttttgagacagagtcttgctctgttgcccaggctggagtgcagtggcatgatctcagctcactgcaacctccgtctcccaggttcaagcgattctcctgtctcagcctcccaagtagctgggactacagggcgtgtgccaccatgcccagctaatatttgtatttttagtagagacagggtttcaccctattggcccggctggtctcgaactcctgacctcaagtgatctgccctcctcggcttcccaaagcactgggattacaggcgtgagccaccgcacccggcccagctggaatctttctatttctccatttattcactcatcctgtgctcgttcattcatttactaagtcactaattcactcactcaacaaacccttgagttcctaccatgcttcaggcctgaagggataggtccccagggctgaggtctctagggaaaggccttttcccagaaggcttgtaaggtcctccatcctggccattgttccgggattcaacctccttcctctcctcttgtctctagctggtgaccattcagagctgtcccagaaccccaagcaggtaagggggctttagcaggaggtgtatcaggtggctgggcggagggtacagaggctgctggggagttggacagtcccatcggccaacggaggttggatggagcggggagctcacccagagcaggacgaatgatgctgggagatgtggtcactaggtcttgttctgagtcctggccagcctgtcccctccccaccaaggcaaatggaatgaagggaggccctcccagccaagctgacctggggaacattaaactactggacggagtggggtggaggcaggaaggggaaggtgggggctgaggtgctcagagcatagaggaaggggagacacatgcagagacgcagggacagaggctgcagggctccgtggacacccacctgggacctcctgcccacccaggctgccacgcagagtgagctgcactacgcaaatctggagctgctgatgtggcctctgcaggaaaagccagcaccaccaagggaggtggaggtggaatacagcactgtggtaagtgcaggagcccggcttttgggcatgcggcccctgggctgtgccagggcacccctgggagggtgggcagaaggggaaggaaggggtcggcttggtgatcttgtgcctgtcagggacagggccacatggagatggagcaagtgtagattttgccagagcagaggtccttaggagggcttggtgtcattgtggtggggggtttttgggggtggccagcagctatggctctgacagtccgtgaagtccagcatgggttaagcacctgctgtgtatcgtgagccaagctgagaacctgtgacttctcactgttttggtctcatcatctctttgacatcaattctgctttcgggtttttgtctgtgacccgctgtgggtcaacccttgggcgcagccaccttcaactgggatgatgggatgggggctgcctccctgggtcgtgacccacctgctagtgggagagttcaagcagaagctgggggtcacttggcagagaggatcgggagggatgtaagcatcagcagggaagcttaaagtgcccccaggcctgggagctgaagaggcccctcagacaagtcgtgtggtgccatggagggctggcaccagggtgacaggggacattgttgctggtctgcctggaaaagtggcccaactccctgggatatctccagcctggtaccgttctccccaggccgccgttttgcacctgacaggagaagaggggatccagacctgccacttccgggtcccctgatagccgcaccgttccccaacctcccgccagctgtctgcatgaggatgagggtggtctgggggcccagggtcctggatggctcctggccaagttccttccttccttccttcctttctttctttctttctttctttctttctttctttggaatctcgctctatcccccaggctggaatgcagtggcacagtcttggctcactgcaatctctgcctcccaggttcaagcaattctcctgcctcagcctccagagtagctgggactacagacacctgccactacactggctgatttttgtatttttagtagagacggggcttcaccatgttggccaggctggtctcggactcctgacctcaagtgatccgcctgccctgacttcccaaagtgctgggattacagtactgagccaccacacccggccagctcctggccaagtttctgagcgcccctgcactcaagcctgactccttccttgcatgacatgatcttgtgtccacgaagctgcatggcctgggaccagcaacagccttgttctaacttgttgtctcatgatttaaagtggatggcacatggtcttactcttctcccagcccccttggtacaagttgggactcatgcccacagtacagcaagttaatcagagctgcagggccaacgcagtacccctgtactggcttcaactccacctagagaacgaggggtcctctgcagaaagggatccatggctgcttcgttgtgagaactttcctttttttttcttttcttttctttttttcttttttttttttgagacagagtcccactctgtcgccaggctggagagcagtggtgcaatcttggccattgcaacctccgcctccccggttcaagcgatcctcctgcctcagcctcccaagtagctgggattacaggtgtccaccaccacgcccagctagtttttgtatttttagtagatactgggtttcactatgttacccaggctggtctcaaactcctgacatcaagtgatccacccgccttggcctcccaaagtgctgggattaagggcgtgagccactgtgcctggcctcaagaatatttcattaagagaagcacagaggtgtcttgggggagcccagccaggtctcagggcctcagtttcttccctgtagaatggaccaggctgggtcagccctgaggagcccccggagcctcctgcctctgatgctggggatgttgtgctgctgcttgcccagttggggaggagcagctgggtggacaggatcatagagaaaaagaggccaggacagtggagcctctacagtgaggcctccccaaagcccctcaggtgtcctccctcctccatcctatgttgggggtcctttcttcccttgcctctcccaagtcttcagtttcttggtttctctctgcaggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcc

SEQ ID NO: 370 - DNA, 18416 bp, Homo sapiens; identical to SEQ ID NO: 369
  source 1..18416: mol_type = genomic DNA

SEQ ID NO: 371 - DNA, 10301 bp, Homo sapiens
  source 1..10301: mol_type = genomic DNA
tccagagagattgacggattcattgaatatcaacaggaagaaacggtgggaaaagaatgacatcacgttgacaagcgcccatgtcccctcgcccctgagtccagctggtgaagcaccatgctttggctttccctcccgcggagcggtgccgtcctccctgggtctggtcggatcttcgggaagctggatccaggaaagcattccaggaggtagggccctggggctggtggactgtgggtcttggtccctcacagaatgactcaggggatcttagccgggctcgaactctcctctctggccattatggaattttcaggcccatcattggccagagacctaaattcagttcaaagtcagagaaagtttctctttggctgaaggacaagaagaggggaggctctgggtgccatgctagggaccagagggtcccctctcctttatccactgctgacagtcagtactccctattagaaccaagagcaggttggaggcgtcctcatgggtgttcaaagggcaacatgccgaacatgtgtggtgtgtttgcttgtgggcaggtgggggcgggagcacatctcacatgggaaggtccctttggtgtgagggtccctcaaccatacagcacaaagtgaccacattcaagggcctcatcgccgtgggtgaagcctgtgaggagacagaaccacttccctaggacagttttcattagtaacatgatttcaacatcaccgaaaagggagggtgccatttcctgcgatggttttcgttactgccctccccacctggaggtggttcttgaggcctgacaggctcttttggggaggagacccaagctgtcatgctgaggaggctcccaagctgcagcccctcggaggtgggggaataggcagggagcttggggagctaggaggaggaagaggtgggagggggaggacaagcaccgggccgggccagggaggttcccattgcctcctcagccctgtggactcagagccatgtcctccctggggacagggtccatccagcccctcatgccctagaaccaggaactcatcccagaatcaccctccttgtgtgtgggatcagagaggtttcctatgaacataagtcattaaaacccaactttgctagaaaaaaaaaaatttaaaaacacggatatatcaggttctcaggcaaagacggtgttgagttggtctccggaatgatggaagtctagggctgggggggtctcccccaacctctttctgtactttggtcccatgctctgtgcccgagttattccagcagtggggacagagtcgtccagtgcttgagctccatctctacagctcctgaccaagagaacaggtgctggcaccccaggaggtgatggtggctcaggagaggacctggctaagtccctgagctgtgcagaacagggaggtgcccaccagctccaaggccagggcggaggcccagggcccctatctcagtcactgcatcccgaggactcgtagatgttccttccacagcccgagtctcttctggaaacgtggccagggcaggaaggctctgcagatccatctctctaagtggccatgtctttagtcagaggttcggagaagttcatgtagataggctgttcccctggctcctcagggaccctctgagaccccttcaaccagaggatggcagtgaccaagatgagcaagatgggcaccttcacaaataccaggagcatgtagtggttcctggggaaggggatgcagtggtcagagccctgggcatccccaggccatgtcactcccatcccctgaccctgtgagccaccagccaaagcctgtgaccctgggccgggcagccccactctgaagattcctgtaaacctcctccttggttcaacctcaaggggtcctccaacagtcaccttggctggttttgcacggggcccatcttcctttctaacatcaccttctgggaccctctttgcccaaagtacatctcagctcaacagaagcgccagaggtcaccaaatacaggttgtgtttcctgcctctgttcctgctaatgctagctccaggctggtaaatcacccttcctgttctgtgtcccttgatgtcttgcaccacagagggtggtatcttatctccccctggcacccattaggccaccaatgcaaggttgactgattgactgggagaatgatgctcactgagaagagttctgcagagcggttttctggtgagagctagagtggggagatggtggattgcagtgatgggggcaggagagagatggagggtgggcttggggccttgactctggctagaacaggtgctggcatttggtgacaggcaggagttcccaggcttggcttccccttaggagggaccccaggtaggggcaggagaaagaaccacatgactcacctcttgtgggagccgatgaacactgccatattgctgttggtaggtgagcttgctgttgtggaagccgctccctctagacacaggcaaagtcagccatgggttattagcacagttgggagctcatgcatgggtcacaaagccacgcgaccctgccagccctcaccagaagacccttttccctggagtaggaggatttttctctcctgctacagcccctcatgcttctactgagtcacttcaatctcaacacacagacatttttcctcatcatgttcagatgtggcaagaaaaattaaaaattaaacaggagtaaacactgtagtttattctgggagagagaggttttttcatactttctttccacctatcctgcaagtgggactattggatggggaaataaatttctggtcttttccactggagtggtgcctgagcagggcttaaggagagaagattctggaaatgggctgtccagaaattggggtagtccagaaaaagggaaaggggactccagaaggctcatgaagaaaagggcacactccagttaactagagaacatcgactatgagaaacggaacatttttaggagcaaccatataggcaatttgttgggggcagtctggtcaggggggccctgagcccagcccagcactgagtatccatgacccaacagtgatcttttatttcagtcctcggccccagcaaatttttctcaaaggtcccaggctgtccaggcacggtggttcacgcctgtaatcccagcactttggaagaccaagggaggcagatcgcttgaggccaggagtttgaaaccagcctgggcaacatggtgaaatcccatctctacaaaaaatacaaaatgaaccaggcgtggtcatgtgcccctgtagtcccagctactcaggaagctgaagtggaaggattgattgagcccaggaggtcgaggctgcagtgagtcaagttcaccccactgcactccagcctgggctacagactgaaaccctgtctcaaaaaacaaacaaaacaaaataaaacaaaacaaaacaaaaaagtcccaggctttggccacactaggtgggctcctgtctgagctgcaggtaattccaatcacaacagttcctatggagcccctgatcgttttacaggctggtacccctgtagatcccccacccaagactccggaacatctctctccctaaagctccacactggccactgttttttgtctctttgtaccgcctgcatgtcttgctcaatcccctctctgcccccatagatattctgggtttcccctacttggcagccctggggaagtcttgcttgaccctttctggactcctctttactcagctgcagccactgtgtccatgtgcctctttggtcccaaccccaacagtacacaggcttgttctaaagccggcattgtctatttccacatcaccaccaaatggacccgagtggacactgagctgatgaagtactgagtaggggtgtgcgggtggaagtgggggttgggggctgcttcccagactccagcaacagcagcaggatgaccccagagtctatcagtagagtccaaggcatggaggagaagccagggcacccagagtggtccctgacgttgcccgtgatggaagccatccttttgctttaaagcgtccactgtcacccatgcacctccctggggctttcttaccccgtgctcatcttacacagccagataaagtagcggagcaggtggctggggacctagagaggagggtgttgtaagacacccagagctactctgggttggtgcagttagtgggactcaatactaggaccccctgggcagctctaggttccttctctgccatgtcatgagcagggctgggccaccagtcaccaaagctgaggtccccattcccacccccatcccaagccccacctggattccttggagagacctcagggactgagatagcagagcgatgctggccaccactctcccttagtttctgtcacctccttcccagtcagtttgtctgcctgtctgtctgtctgtctctctctctctctctcttaggctcaccatcattccctttcagccttggaggggagcaggtaagagcactgactttcccagccctgagctccagggcctccttgtgtagatgagaaagttcttacctgggtcaacgatcactttcacttgagtcccaaggtcaggtcctcttctttcaatcccacaccagtaaacatctgcgtcatctcgcctgagcccctccatggtcacagtgaacgtgcggtctttctgattgtccttgatggacacacggtcactcttctctccttgctccgaccctctggtttcaatgaggatcttgcatgtatcccagcgcacccctcggcaccaccacttaatgtaggtctcccatccttgcttatagtggcattgaaccgtcagggacccctgctctggggctctcacagactctgggccttggatggagaaacagcctggaaaacagaatcccaagatacagctcattgcaccggcacgaacccctgctctggggctctcacggactctgggccttggatggagaaacagcctggaaaacaaaatcccaagatacagctcctgttgcctgagccagtttggtgtttaagagtcccgagtgtgtctctagcacacccgattcctcatccccatctccctctcagtccattcccccaccagcttctagacctgcttagcatgtgacaccatggtctcctaccaccttctttccttgtcctctcaatgctgttttcatcggagccaaatatttaacaaccagccctctgggggaaaaaatctctggtttaggagctgggcacggtggctcacacttgtaatcccagcactttgggaagccaaggtgggcagatcacctgaggtcaggagttcgagacctgcatggccaacatggtgaaacccagtctttactaaaaatacaaaaattagctgggcgtggtggcagtcacctgtagtctcagctatgcgggaggctgaagcatgaaaattgcttgaacccgggaggcggaggttgcagtgagctgagatcgcaccactgcactccagcctaggcaacagagtgagactcttgtctagaaaaagaaaaagaaaaaaaatctggttttaatatttgccaaattccatagtgtaaatactcccacggtggcagatgtcaggtaatccatgtgatgtcactggacacagagctgggaaaagatgtcccaagccagctcctgtgagccagccccagcacactgcgggggtacccagggttccctctccagccttcatcttgtctcacctgacaagcctccatggagggagtctctccatttccatggctttaatgattacctgtttcctgatgattcccaaatccatatttgcagctcagactccccttagctagcccaccatttacaaagacacactggatgtctccaccccagattccttcgttgcagaattgaatgcacttcctctcccaccctgaactactcttcttcagtatttttttctagtggagcaattggatgtggcaagagtaacaaaggcctggtgaaagctgaacaggttagaggtgagcataatcaaatggcagtccgtgcctccgctgattgactccagttaggctgtgtgtagataggctctttccttggcaatgacacgggtttcttgatcacgcagaagtggataaacaggcagagaatcacaggggaagcctctcttgactgtctcttggcctcagagcttcaggcccaggccaggggtctctgcagggtggagaaagccaggtctatttctccaggcagatgccgcctcctcacagcttgggccttctccttgaagctgtgttagttttcttgaactttgcattcgtggttggtagaataatgtcccccatagctgttggcatcctcatacacagaacctgcgaatatgtcccctgacatggccagagggactctgccgatgtgatgaagttaaggaccttgagacaggaagaatatcccgaataatctccatggatattctaagtgaaagagggttgagggagagtccaattggaagatggtctgttgctgctttgaagtggaagaagaggccaccggccaaggaaagcagatggcttctagaagctggaaaatgcagggaaacagattctcccctagaataggggttcccaaccccaggacaacagactagtaacagcccatggcctgttaggaaccggaccttacagcaggaggtgagcggtgggcaagcaagcgaagcttcatctgtatttacagccactccccgttgttcaaactaccacctgatctccgcctcccatcagaccagcggccgcattagattctcatagaagtgagaaccctattgtgaacttcgtgtgtgagggatctagattgcacacactttatgagactctaatgcctgatgatgtgtcactgtctcccatcacccccagatgggatcatctagttgcaggtaaacaagcttagggctcccactgattctacattatggtgcagtgtataatcatttcattatatattataatataatagtaatataaagtatacaataagtgtaatgcgtttgaatcatcccaaaccatcctcaccccactcctgatgtggaaaaattgtcttccacaaaaccggatcctggtgccaaaaaggttggggaccactgctctaaagaaacccaaccctacttgcacctcaattttaaccagtaagaccacgccaggctctggtcttcagaagcatcaatgagatgatgaaattgtgcagttctaagccatagagttcatgttaatttgttacagcagccactggaaattcacatggcattcaatcagcagaaccaacttgattctcttcaaaccagcagctccaccacccagccttcaggaagagcttggcatcttctttcatgctgtcctctccttcagcccccgagctgattggtagccagtttagtcagctctatcctagagatgctcctcagtttttttttttcttctttcagtctctgccatcgcaggccacaaggacagcatgacatcagagagagtgtgagctttgatgcagaaagacttgacactgaactagttgggaaaccctggcagagttgcttaacctctgcaagtatcgcttccttattcataagacagtcatgctacgctctactttgaaggtggtaataggacttggatgtgtgtaggctgggcaaggtggctcatgcctgtaattccaaagctgtgggaggctgaggcaggaggatcgcttgagcccaggagttccagactaacctgggcaacatggtgaaaccctgtgtctgcaaatgcaaaagattagccaggagtggtggtgcatgcctgtggtccccactgcttggggggctgaggtgggaggatcgcctgagcctgagagttcaaggctgcagtgagttataatcgcccaccactgcacttcagcctgggtgacagagtgagacactgtcttcaaaaaattatttatttttaaatttaaaagaagacttggatgtatgtccaacgccagacatttggggtttgctctgtcagtgacagctcatcaacaggtcagaacttcatctgtgcctggatcatggcagtggcatctggagaggtcttcccagccccagcagcatcctccccaactctcctctcctgaggattatggccttcataatcttgtcttttgtgtttccaacctcatatccaactcgccacccccaagatgtcctgcacactgacagctccctcagctttcctctccatactgctgcctgagttgggtactgagactgtctcctcctcctcatcagctgcacttgccctgagcatctaaaagtcttttcggggccgggcacggtggctcatgcctgtattcccgcactttgggaggccaaggtgggtggatcacctgaggtcaggagttcaagaccaacctcaccaacatggtgaaatcctgtctctactaaaattacaaaaattagccaggcatggtggcaggcaccttaatcccagcttcttgggagactgaggcagaagaatcactcgaacctgggaggcggaggttgcagtgagccaaggttgcaccactgcactccaacctgggtgacagagtgaaactccgtctcaaaaacaaaaaacaaaaacaaaaacaaaatacccaaaaacataaattggatttgtcagcaatcactaacagcagaaaagagatgctgctgcattgaacaaagtgtcatcaatcccagcttcagtcattcaaactgtaaatggctcacgatgtaattagtcccgtttaaaaaaatatttgggggtttctctaaccacagaatatgatggctggaactattaatcaggcttctatatgttgtcaagagttggtatgaggaacgatagagatggaaatgacagggcagccgtcagcttggagcagagccccgttgaacgggctgaagggtggaagtccagccaggactggagtcgggtctcagaactccccagccatgctctttcctgttgtccctccgtggactgctctatctgtgccagatggtcagtccctaggcaccagcagaaaactgtgtggcccacacacattgcacaccctgcgtaaaattctagattgtcccctaatgccctctaggtgtccaccaaggtttgccatggagaagatcatctagcccttcccactttccacctgggttcttgagaagttttttctttgaaagtctcagctcctgagcctggcgtggatggccttcataatcttgtcttttgtgtttccaacctcatatccaactcgccacctccaagacatcctgcacactgacagctccctctgcatgaatccaccattctttctaagcctccatctctctgcccaggtcccccaacacacacacacacacacacacacacacacacacacacacacccaactctctagagtgttctcctctcagctctgctccagagactgaccttccttctacaaggcacatcaagtgcacagcttcgtgagtctttctctagtcaccagagagaactgcttcatcctccgcacacgcctccaccaatgccttattgtgtcctgcaattgctcattgtttatgtgtatgtctcacccactaagccatctggagtctttttactttattttttttttgagacaaggtcccactgtatcacccaggctggagtgctgtggtgcgatcataactctgcagaattgaatacctgagctcaaaggatcctccagcttcagcctcccaagtagctgggactacaggcacggtcaccacgcccagctaatttttgttcattttatatagagacgaggtctcaccatgttgcccaaactggtcttaaacgcctggactcaagcaatcctcccaccttggcctcccaaagtgttaggattataggtgtgagccatggcctcaagcctggagtcttctttaatggccagttctcctcctcttttttcttgatgtcctcaggccccgaagcacacgatgtcagtccccagtgcacctttgtcgaatgacttcacaaagccacctctcatttccctggatgtggaaggacaaatgccctctgcctcctgccctgcccctgtcataccaagcgcccaaggccccagccccactcacctgagaggctgagaaggagcagagcagggggcagccacatggctctgccttcccggctcctcgtccgcctgatctgcaaccagtggcaaatgcagatcccagatgcactctggaagttctgcctgagctctggcttgcaccttctgcacatctagaccgccttt

SEQ ID NO: 372 - DNA, 5106 bp, Homo sapiens
  source 1..5106: mol_type = genomic DNA
ttctcactcaggtctgactgagtgggcctgatacatcccaaacctacacattgtcatttattaaagtttgaaagcatcattgaatcgacacactcagcaaatggaagcagccgcatattctacactcctggacccagggagtgtgggccattatggtggcaaaggtgcaggggagtcctagacctgcttctccctgtgaaaacggtggaggaagcagtgccaggctcctggagaaatggaagggtgcagggagggcatccgggcactcagaggtattgctgacggcccgaggcttagctggccggggcgtgcacatgagacgtggactcacagctcagggcgtccatgtccgtcaggttcacatgtgacacatgaggatcgggcacagggaaaaggctgaaggaggctcacaaaggattccaggagatgtggagagagcagcccgggagggagtggtcaggaggtcattccagtcccccagaggggctctgttgcagcacagggccttgatggacagcagatgctactggttctcacccttgggccaattctgcctgcttctagagcttctctgaggtctgttcacccagaggacggcacccagcatgctcaggagcaggggcagctccaagaggaccaggagcaggaagcggacattgctgaacagggagctgtggggacacggtgacaggcagtgagtcacctccccaggggaggcccaggtgccctccaccatcccctgacccttgtgtcccaatcctgtgaccacagccaaccacataagcacccccctggacagtccatcccgtctcagcatcacggcccctaaccctcagcctcggatttacccttgacctgaggactgtgacacaggaagggcaggaccatgagaggacgtgaggtcacgccagggatccaggcagggtctgtgtccaggacgcagctgtctacctctgtgctccccatggagggttacccagctggggtcccggaattcacaaagggttatttgtttggtgtcaactctcctgtacacagcgtttccaggagggcagggaccatttgtttcattcacagtgagtacctgctgcctacccggagtctccaataatctgccctacaacttcagtggttgttgaaggaattaatgaatggacagctcagctctcagctcctcagaggactgggcttatcaaacaggatgaaactctggccagggctgcgagagaggcaggggagaggaccagggccaccggaccccagagcatctgcccccttccctggcctggccaggtcccaaggctcctcgcaggacatttgcctcactcctccctccacctggacccttcttcctccagaccccagagtgcccagcccccaacccttgaggtctctgtgctcatgtcctctaattctcaaaccctcttctgatcatcgtcagtgaaatagcaactccaacacctgcacacgctctccccaaacccaagagtcaaacatctcatcccagcattcattaccctttgctgtatttgtacatcagcctctgtgctgacttgctcaatgcgtgaatccacgcagtagaactcaacttccaccagggcaggacagtggctgtgtggttccctgctgtgacccaatcccaaaaggagcgcctgacacttaatagaaccttcacgtttggtgtgggaggtgcgaacaaagaagggactggaagaagggacatccgagtcccctaaacatcacacgcagtggggaggccgccagcgtggcccagtcctatgcgcaggcaccttacccagggtgtgggctgggttcggggctgtcctttctggtcacgctgggccaggtgtgcacgggcagcttcgtgggaggacctgaggtgcccatggagctctgggggctggaggctgtggtcgtcccggctgtgggtgaaacacaggtcaaccttgatgacatcacatgggtctcccacttactctcacctgttctgctccaattttcacagacaaggtcaccaatgatgtgctggacagatgccctgcatccatcatgccccacggccacacccaggcctgaccagggtcctgggcctctccttgtcccatccctaggtactgcagagccaggacaccatttcagatgtgagagctgccctgctcacctgtggcaaaggtacgggtctccaggtttcaccccagccagggagggacagggtgacctgggggaatggggtgatgtttactctgcgaagggtgacccagagtgactgcgaagccagggccctgggcacagcagtggctggagagaggctggaagtgaggacaggaagtcagtggggtcctccctgaacgatgggacccgagtccactcagccccaaatggcagccatgctgcggccccacaaggccattggaccatcctctcagcaggagggaatgcccaggaagaaagatctagagaggggatgcccggtgaagcctgggcggcggcccgtggtgaatacagctggataagggccctttcctcctctccctggcgccctcaggtgggatcttagctcctcactcctagataggaaggcacaaagggcgcaggagggacacgtcgcccccggggaaatggagaacaagaagatgctccgaggaacctgggacattgtcagaagaaaacgatggaaaagcaaccacactgaggccactgggtttgtgtcttgtgagacaggagggggcctttgagggaagaatgatcttcggcacgggaaagggccctcaggtccgtgccagtctcagctcatttccatccacaggtccctttgcctgagggggcaatttctggggttccctcctgtggtaaaaggtgccagagaataagggggacacacaggtcagcctcaggggcaggatgtggttcccaggagcatgagaaccccacccagggctctggggctccttcctgtgtcctccagtggctgctgcaggagctcccaggacagggctgtgaggctgcggcctcaggaccctccagacagggcggcatccatgcaggccccagggcaggggcagccttgagtgagaggagccaatgatgggggggtccaattccccgtggggaagagcgagttagacccaggcgggacagtgggcacccttcagtatggatccggcccttgtcaatacagggaggtagcaaggaccccagagtcaggggtggcctcacagaccccacccaggaaagtttcaggcctgaggccgtgagggagggcccacagcggggggtctccagccacagggccagggtgcttttgtgggcgcccaccctcccaacacacacatgcaggtgcacacacacacaaaccacaccacaactcctatgcaggcacgcatacacaaagacgcactcacactcatccacacacagcggcacacagtgtcctgactcaccaacccccaggctcacaccctcctgttccacttctttcttcagggacagaatgaccagccctaggctcaggcaggcctggtgctgagaaaaggaggggctcacccgggaacacggacacctcaacctcgacaatgggatcatgaaagtctcggagccacggtgtatccaccccacaccagtaggtgcctgcgtcctcctctgtgagattctccagggtcactgtgaagctgaggtttgcaggactgtccctgatggacactcggccattccttttccctgctgaccctttggtctccacaatcttgtcacatcggagaatctgtggtggtctgcaccagaatttgttgagggtcctgtgttccttctcatagcgacactgcacactcagggatccccccacggggcccgccacggtcatggggtggctcagaggaaaatagcctgaaaaatacaagccaaaatcctgtctccttaccagaggggcctggtcaggggtgccgcagtgtcagcccctcatggaccctgggcgtgtggagaaggcaatggcaggcaggcagcctttgtccacccaggaacagggactgagggtgggaggctccctctgtgcagaggtgggaagggcatgggaagtttccatggagactggaaaggcaaggctagggaaacactgggtgtgtgcgggcctgtgtgtgcatgtgagtgtgactctgtgtgtgtgactgtgtgagtgtgactgtctgtgtgagtgtgactgtgtgtgactgtgtgtgcatgtgtgactgtgtgtgcatgtgagtgtgactgtgtgtgcatgtgtgactgtgtgcatgtgtgtgtgagactgtgtgagtgtgactgtgtgtgcatgtgtgtgagactgtgtgagtgtgaccgtgtgtgcgtgtgagtgtgactgtgtgtgtgatcgtcccagataaaatttgtgattggataactttggcaatgacagtcacagcatcacctcccaccagggcttcctgtctcgggcacagaggaataggcctcccccgtgctgtgccctgccgcctgctgtcccctggtgaggcagctgctgaccgctcctgggtgctcctttgccctcctcccctctccctgccccactcccctctatgaccgctactccagcgcctgcacccctccctgccctctcccactcaggacagagctccccaagtccagggtcggcccactcacctgggacaagcaggaggagcagagctgaagaccgccacgaggcccaggccctggcagtcattcctgtaacacgaatgtcacctgccactgtgcaagaccccaggaggggacaaaatgtaatctcctcccagcagatctgagcttcgcttctgcttttcttctgctctctgcttccttgtccagccctgtctcaggtctgaggctggagagggtcagggtacaggaagctcagggagagagccgcctgggctgaggccggtgctgacagctctgggatggtgctagtggctcctctcaaccctgacgtctggcaaagtccagggtcccttgggtggcgatgcagccacttccccacagcccacagcttctggcttcagtgtgttactcacactgcagaaggcagagccaagctgggccatttcctaccacatgggctgctccaccctctgt

SEQ ID NO: 373 - DNA, 12260 bp, Homo sapiens
  source 1..12260: mol_type = genomic DNA
actctcatcatcgggctgactcctcctccttcaagaccttctttgtggtctgtttacccagaggacggtccccagcatgctcaggagcagaggcagctccaggaggaacaggaacaggaagtgggtgctcttgagcggggacctgtgggaacacggtgacaggaaatgagctgcctcctgggtcagaggtctcaggtcttctcagctctatgcccagatcctggcttccaatgtctatgtgagggtaagcctggaaccccagacaggccagcccctttggtggggcacagtcacactgctcaccagcgaggctcccagtcctccctacacctccagtaaactcagcctggcattcaaggtcccgtctgccaactcccatccggcctttttggctggtctcccataactcctcctcacctatcttgaaggggtttagcattccctgtctctacttacctcggcttctgctgcattctgcacccagagggcctctccgccctcatcgctgcctgtgcaaacgctacccacctttcaggtatcagatctgacatcatattcttgaaggccttggaggctgaccttgctctgaccctcttcctgtggaccagcacctggccctggggttccttatgttccctgttactttctatggatgtgtaaggcccagaaccttattgaccatcaattccaccccctcaccatcctccacccacttcccagggtctcgacctcccaacttgggccttcgttgtttctttcacctcagcgcaacttgaagccactctcagctcacggataaattttaaaaatcaggccaggcgtggtggttcgcacgtgtaatcccagcactttgggaggccaaggcaggtggattgcttgagcccaagagttcaagaccagcctgggcaacatattgaggccccatctctaaaaaaaaaaaaaaaaaagacagaaaagaaaattcaaaattatatccaactccagaatgccggatgagccctcagatgatgggactgagggtatttgggggagatggaggaggggctatacagcaggccacgggtcaaaatgcccccaaaggtccttcccagcatcttcactcttggggctctcctgctacacctctggagtcctttgccctctgtcccctgacagctaaagtcccatcagtttgcacaaaagcatggaggaggaaaaaaacaaacaaaaaaaaaacagtcgaggagtcctaaagccagctccgtgggtggagctctgcagatgcattctcagaactcaagatcgagtgaataaaaaaaaaaaaacagagttgaactgcagagggaactggcagaccttgaggagtagttccaggaggactgagccagagacacgggcctctgcgctgggctctagcaggagcaggacggtctgtggtttgggctctggccttgacctggggggcttgaccacagcaggccgtgatggaacccaacggctagctatcaggtgccgacctctggggactcctctggacacctccagggctggtgagcatcagactaatcctccagacccctctgccagcttgggagggtgagaacgccaaacttccagcttccccctttccctctagcattttccattcccctactctggtgtcttgggagagagaggctggaacaatatttgttcttgggcagaaactaggagcagatgagagaggtgtctctcctaacccactaaaggccaaacctcgatatgccctcttgaccccaggaggtggggagggcatgttcaggcccctctcctgccaccttcagtcatgtggtggctcatgtctgtgctgcagagtttgccttcatgtagccaacacttagatgggaaatcttattttcctcaaaggtaaactgagattggggcaggccatcggaggtttgcagtgactttactgatacaaagacgaaacagcaggggcctatgggggtcccagcctgagtacccccagaaaacagggctatcagagttaacaaataaaagcatagaatgctcagttaaatttgaagttcagataaacaacatatgcttttttagtataagtatagcccatgaaatagttgggatatacttatgctaaaaaatgttttgttgtttgtctgaaattgcagtgtaactgggcatgctattgttgtatctggcaacccctgttagaggagaggccatggggccaggcctgtgcgaaagtggtgggacctggctccacctacctggtgagggggctgctggtcttctgggtggctgcagctgtgaaagccaggcttgctgttgtggttgtccattctgagactgcagtttgtgtgcctaaacatacaaagcagaacacggttcaccccttccatggatggcccagctctggctgtggccctaaggcttctccacctaggaattaaggagcctctgccttggggtccaagactgtctggtcagcatccaaaatattacatgaattatcttctaaagagaagttactgaattattaccatgtgagaaattctgaggagcagactaaggagggaatttgcaatcatcagttgcatggcacagcttagcacactcgatagcattccgctctcctcgggctaggctagctcttttctgagtctcggccacagccgaggtgaactccttaccgcctgttctggagtgattcggcggctgagctggtggccccctcgctgagccacttctggagagccccggattcctggctctctgcagccaggcccagcgccctccacctccgctcttccctctctggccgtttcctgtcttccagcagcttcccaatctcaccctccctacccctgttgaagtctggctatgtctgatgcatcccagcctctgctgtgtgccaattcctgctggaccacaccctactcacgctgacggtgtgtgtagtgagttttgatattcaaagtttgcttcaggagcaatctaataataagagatcacagcatcatatttgtctttttatatcatttttctgggattaaatcaaggtataactgacacataataaactgtaaatatttaaagagaacaatatgttaaactctgatgtatgtgtatacccggtaacaccaccaccatgatcaggacagtcaacacattcataatccccatgcccgccctcccccttactctgtccccaggtgttagggactgaactgtggacccctaaaaattatatgttgatatgctagtccccagtacctcaaaatgtgactatatttggagataggacctttcaagaggcaattaagttaaaatgagtttgttagggtaagtcctaatgccatctgactggtatcgttctctgaagaggagatgaggacacacagggagacaccaaggcatgcgagcacagaggggcaaccgcaagaaggggtagcaagaaggcagccacctgcaagccagggagggaggcctcaggctcaactgaacctgccaacaccttgatctcggacttccagcctccagaactatgagaaatacgtttctgttgtttacgccacccagtctgtggtattttgttgtgacagccttagctaagggatgatccattttctcttactatctatgagttggcattttccagaatctaatataaatggaatcatacagtgtaaatcagcttttgagctggtttctttcactcagcataactattttatcattggtatatcagtagaacattcccttttattgcaagttgtattccattgcatgagtatttcactttttttttttttttttttttgagacagagtctctctctgtcactcaggttgcagtgcagtggcatgatcttggctcactgcaaccactgcctcccaggttcaagcaattctctgcctcaccctcccaagcatctgggactacaggttagtgccaccatagccagctaatttttttttatttttagtagagatggggttttgtcatgttggctaggctggtctcaaactcctagcctcaagtgatccacctgcctcagccttaacaaagtgctgggattacaggcgtgaaccaccacgcccagcctgtatttcacatttttaaaaaaatccactcacttgaattgtttccagttttttgctattacaaataaagctgctatgaacattcacatacaggtctctgtgtgaacataaaactttctattattttgactaaatatggaagtgctgaggggctggatcatctctggcgggcatacatttcatgtctgaagaaactgcaaactcttttcccaggtggttgcatcatgtgcattcccacctgcagggtatgagggctccaggtactcgagagtgtttccaacacttggtgtcaaggtcagtaatgttaacttttgttacaggccgaaagaatgagagtcatgaccaacacagtatagcactggaggctatatgagcgaacagaaaactgttctcatgaaagcaggatgttggaaaactggcaacggtgtctgctgcccgaaggggtgctgagggcagtcacaccccaagtgctgtgttccttgtgattatctataggaacatctgaagcctgttgtacaaagaaagctattgtgtgtacctgtaataaatcaagcagctgaccaaccattacctctccctcccttctctttctacctaataaatacgaagggctgtagaagctcagggcccttgttcactagaagcaaggagctccctgaccccttctttcaaaacagatctctttgtctttgtcttcatttctgcattcgtcccccctttgttcaatcccctagcaaccaacagcgacaagtggtggccgggacaggaacgtgagcaaagaaggtctgctggagcagagaaagagaaactgacaagacgaacgagaaaccctggaacaagtctgccggcagccaataaaaggtcagtgccctaaagaggtactgggagcggcagcagatacaagatcagtgccctaaagaggtactgggatatcaggtcagtgccctagagaggtactgggaatgggaagttttctgaataagggtaacatggggcagaatttgtctattgaggtgcaacattatgtgcatttgcttaaagttttacttaaacaaactggtgctcaggttagttctcaaacattaattaagatgctgaagaaggtcactatacataacccgtggtttccacagacaggcagtcttgatgtagaaatttgggacagagtaggaccaggattaaaacgggctcaccaaaaaggtcttaaatttgatctttttgttttttctgcttggagtttagtccgtgctgtcctcctgccattatcttcttcttattctgctagacagcaggaatcatattccaagtctaaaaatctgaaaaaatattttgtcccacccacagtaccaattaaaaataataaacaggagaaggaggatgaaaactggcctgtgtcaccccctccagtagcagaaacgtctgtactgcctccttcagtagcagaaatagagaccccaatacaaagaattttatgctctgctgctatagctggaaagcccttaggaccttgcgcttttcctatttccataaggcccgatccaaataatcctcagcagtttattcatgaacacaccccactacagtttaagttgctgaaggaattgaaagcgagtgtagttaataatggagtacaaagcccatttactttaggattgctagaatctatatttggtgctatgcgccttccaccctttgatgtaaagcatttggcttgcacttgtttgtctgctagtgcatacctgacatggaatttaaattggcaagaactgtgtgcagaccaggctagacagaatcatgctgctggacacggagacattacagaggatatgctgttaggtaatcgtccttattcagacctggaacatcacatggcactcccagacactgcttataagcagtgtgccttggctgctaaacatgcctgggccacaattcctgaggaaggggtcccagtacaatcttttttacatatcatgtaagggtggccaatgcacattttcttgcaagattacaagaggcggtgaagcatcagattcctcatactgcggctacagaaatgctaaccttaactctagcttttgagaatgcaaatgcagattgtaaatgtgcactggcatctgtgagatgtacaaaaaactcgggaaattttctcaaagcttgtcaagatgtgggaactgaacttcattgctctacaatgttggctcaagcaatggctaatttagtagtggacaaatctaaaaacggccaaggagcaaatcctaaaatgggaaaatgttataattgtggaaaaatcggacacttcaaaaaagaataccgtcagacctttgggcagaagggatcttataatgcagccccccaccccagaaaaaatgccaggactttgccctcattgcaatataggaaataactgggctagtcaatgccactcaaaatttcatcagaatggcacccccctgtcgggaaacgagaagggggcctggacccgggccctataaacaatggaggcattccctgtccagcccacagccccatctcagggataggttcccggaggcacattgattccctctccccaggaacacctggaagctcaggattcgatctcccagtcagagaacaggtaacgttagtgggaggagacaaacccaccaagattcccactggtatttggggacctttgccaacaggatatatgggattaattttgggtaaaagctgtcttaatttacagagcattaccttagtcccaggagttattgattctgattatgaaggagaaattcaagtagtggtaatgtcacaaggtctttgggtttttgaaccaggagaatatattgctcagctactgcttattacctgccagttacacccttctttacggaggttgggagttcgagaccagcctgaccaacatggagaaaccctgtctctactaaaaatacaaaattagctgggcatggtggtgcatgcctgtaatcccagctactcgggaggctaaggcaagagaatctctggaacccaggaggtggaggttgtggtgagccgagatcgtgccattgcactccagcccaggcaacaagagcgaaactccatctcaaaaaaaaaaaaattgatattatccggtcctgaactcaccaaagggccatctgagcctgaaattttcttcgtgagaagatggcaaatgacaaattctatttcattaaaagatatagagctattccagttatctatttcttcttgtgactggtagtttgtgcctttcaaggatgtttttccatttcatttaacttgttgaatatattggcataaaagttgtttacgacacatattcccttattattcttttagtagctataaaatctgttgtaatgttacctctctcatttctgatgttagtaatttatatctttttcctgatcagtctaggtagaggtttaacagtgtttctgatgttttcacagaaaacatatctcatttcattgatttttccctattacttttgttttcgatttcattaatttttcattgtggtcttaatattatctgtgttctgatgtttgctttgagtttactttgatcttttttttccctagtatcttgagctaaggccattgacttgaggcccttctccttttctgatacagggacttagtgctataaagaagttccaagaaggcactggcagggattggggtctctggttaccagggaagggggtccctttggcctgtgggctgaaactggaaccatcaccctgtcatctgtgggcaacagactcaggcactgagctgtgcagagaaaaaaaaaatgtgcctagaaagacttaatcccatcctggagggagccctgggagccatggggtcattaagagatcccctcaatcccaagcggtccttcagggtcctatgagacctgtcttagtctactttttcttgcttataacagaatatctggaattgagtcatttataaggaaaaggaatttgtttcttacagttatggaggctaagatgtccgaggttgaggagccacatcttgtgagggccttcttgatggcagggactctctgcagagtcccaaggtggctccaggcacctcgtggtggcggaactgagtatgctaagtcaggtctgtctgccttttcttataaagcagttccattcccatgataacccattcatcctttaatccacgaatggattaattcattcatgggaactctgcccccatgacccagtcaccttttaaaggccttgtctctcaatactgccacattggggattaagtttcaacacgagttttggagggacaaatattcaaaccatagcaagacctcaggactcagacaccctctgtcacaggtcactctgagtgacagttaatttactcaagtgggacctcagggaccaggacagagcaggacctgagagacacacacgtatatacactccctcttacctgggttaatggtcacttgaactttgaccccaagatcaattccaggtctctcagtcccacaccaataactgtcagcatcatctcttttgagattctccatggtcacggtgaacacgtggtttttctgattgtccctgatggaaactcgattcttctttacctcctgctctgatccatttgttttaacaaggatgttacagtaattccaatcagctccttgacaccgccacttcaagtaggtctcccagcctgagccataagcacactgcacagtcaatgagccctgctccgagccattcactgttgttggaccagtgattttagcggcaatggagtaacctggaaaacgcaaattcatgtgtcgtcacctcccaccccaagggcagggccacagcctcgtgcattgggagtagcagccaaatccaactgccttataacagtcaaggaagcaatacattttcctcaagacaaatctttgtccttcaaaattccactgggtcaaagtcaccaggaaaatcactgaagagcacaactgcagatccccaaagaaacacaaatgttggcattgagcaataatagcttcctgcagttcacccctctctctttccctatggccagcaaatctttatattccaaggaatgctctttggcaaccatctttgtgttatactggtctgatggggaggaaatggcagaaggcccttttccagaagaatgattgctgccttgatgcttggctgttcctagtggttctaatggtttctggtggctctgctgtagttaatcaccctgaatgaatccctttgaaatcaaccaaatagtgatgccaactggtctctatctgctatgggatccacatcacacagatctccatttcgccatacagtgttataaattccacttccaaaattcctaggaaaagctaacttttaagataaacacaagtaaaggttaggtataaacagagcagcacccattcaacacccttctgcatcttataagttcttctctaaacataatggacatgattcaagtcagttaaagggtgaggaacgggcatacctaattagctccacttttcaaacaatttgatccaggacaagactagtctccatgaacttgtcagcctaatctttcacttgaaaacaattcaaaacagtggaaataccttaagtgagagctttgccagaaattctttaaattcaactgacctaaagggagacccatctaaagaaacgattgattttgatgatttatgcactggcaataaaccatagctgtgattagtgcagcataaacttgagatggaactagaagcacattggagcacttgaagaagccctgggggcaattcctgtggcaggagagaggttgtctctgaaacgccaagagacacccaaggtcgtgggtaagagctcaggctgtgccagagtgcttgggtttgaatcctggctctaccactgataagttttgtgaacctgggcaaattaacctctctgtgtgatacggtttgtctgtgtcctcacccaaatctcatcttgaattgtagctcccataatttccacatgttgtggggggcaccagttgggagttaattgaatcatggggcggtttcccccacattgttctcgtggtagtgaataagtctcatgagagctgatggttttataatgggaaacctctttcacttggctctcattctctctcttgcctgctgccatataatacatgcctttcaccttccaccatgattgtgaggcctccccagtcatgtggaactgtgagtccattaaacctctttttctgtgtaatttactcagtctcgggtatgtccttatcagcagcgtgaaaatggactaatacactgtgacttcgttttctataagtgggaatagtaatggcatctacctctatgttactatattatgtttgttattattattattattattattacccctggatgaatgaaaactttagacttcattggaatgtcttgaaaaaccagggtcaccatggtgggagcggaagacaatttcaccataaacaggcagagctccacaacccaaggaattcctggaacagaaattggactccatgcccaaatctgctttctatggcatctgaagggaactaagaaactacacacgacctcctggggaaagatgggtataggggcttcatttgttcactctgaaaaaagttctacatcagaatggaaagacaacaattaaggtaaatatttaaagaaaaactacatctggaagttatttataagaaataagagctgggtgtggtagctcacacttgtaatataacaactttgggaggctgaggcaggagaatcgcgtgagccctggagcttgagagcagccctggcaacatagcgagactaaataaataaataaatattagctgggtgtcgcaccacatgcctgtagtcccagctactcactcaggaggctgaggtgggaggatggcttgagcctgggaggtcaaggctgcagtgaaccctgatcccagcactgtactccagattgggtgacagagcacaccctgtctcagaaggaaggaaaggaaggagaatatatctgaaaattgtttacagaatataaatttgaagccaggcatggtggctcacacctataatcccagcactttgggaggccaaagtgggaggatcacttgagcccaggagtttgagaccagcctgggcatgaaagtgagtcctcatctctacaaaaaaaaaaaaaataaaaataataataataataataataatctattttaaaagaaaataaatttgagattggaaggaaaaattttcttacaaagcttgatctgagtatagataatatgagaagcacatagatttgttacattttaacagaaatgaaaacactacgtatcaaaatttgttgacatgacagccaaagctgtactcaaatataaatccttgggaaaaaggtttgatgcttcctcaaaaagttaaacatagaattaacataggattcagccattttacccctagatatatacccaagagaactgaaaacatatctccatacaaaactgtgctatgaaagttcataacattattactaacaatttttaaaaggtagaaacaaccctaaggttcattgacaaatgactggagaaaccaaatgtggtatatccactgtgaaatactatgcagccatgaaaaagaatgaagctttgatttgtgctacaacacaaagtaaccttgaaacatcatgctaagtgaaagaagcactccagcctgggtgacagagcgagacaccagctcaaaaaaaaaaaaaaaaaaaagttcttcaagaatggactcactcattagttccttccttcattgatatctgttcattcatctgtttatatggaacagtcagggttgagaaccactgttccaacaagaagctatacttgttttgttttgtgtgtgtttgtttctgcagcatctaacacagaacctgtcagataacaaaaacttgattgctatttaatgaatatgggcatggatggatgaattggcgctgtcattttccctgacatgtctccttcctgagaacagagcgtctctgtctccaagccagccgctgtcattccagtgccttaaagctccagccacactcacctgggaggatgagaagcagcagagatggggacagccacatggtcctgtctcctctcctctccttggtga

SEQ ID NO: 374 - DNA, 9292 bp, Homo sapiens
  source 1..9292: mol_type = genomic DNA
agtgccctaaagaggtactgggagcggcagcagatacaagatcagtgccctaaagaggtactgggatatcaggtcagtgccctagagaggtactgggaatgggaagttttctgaataagggtaacatggggcagaatttgtctattgaggtgcaacattatgtgcatttgcttaaagttttacttaaacaaactggtgctcaggttagttctcaaacattaattaagatgctgaagaaggtcactatacataacccgtggtttccacagacaggcagtcttgatgtagaaatttgggacagagtaggaccaggattaaaacgggctcaccaaaaaggtcttaaatttgatctttttgttttttctgcttggagtttagtccgtgctgtcctcctgccattatcttcttcttattctgctagacagcaggaatcatattccaagtctaaaaatctgaaaaaatattttgtcccacccacagtaccaattaaaaataataaacaggagaaggaggatgaaaactggcctgtgtcaccccctccagtagcagaaacgtctgtactgcctccttcagtagcagaaatagagaccccaatacaaagaattttatgctctgctgctatagctggaaagcccttaggaccttgcgcttttcctatttccataaggcccgatccaaataatcctcagcagtttattcatgaacacaccccactacagtttaagttgctgaaggaattgaaagcgagtgtagttaataatggagtacaaagcccatttactttaggattgctagaatctatatttggtgctatgcgccttccaccctttgatgtaaagcatttggcttgcacttgtttgtctgctagtgcatacctgacatggaatttaaattggcaagaactgtgtgcagaccaggctagacagaatcatgctgctggacacggagacattacagaggatatgctgttaggtaatcgtccttattcagacctggaacatcacatggcactcccagacactgcttataagcagtgtgccttggctgctaaacatgcctgggccacaattcctgaggaaggggtcccagtacaatcttttttacatatcatgtaagggtggccaatgcacattttcttgcaagattacaagaggcggtgaagcatcagattcctcatactgcggctacagaaatgctaaccttaactctagcttttgagaatgcaaatgcagattgtaaatgtgcactggcatctgtgagatgtacaaaaaactcgggaaattttctcaaagcttgtcaagatgtgggaactgaacttcattgctctacaatgttggctcaagcaatggctaatttagtagtggacaaatctaaaaacggccaaggagcaaatcctaaaatgggaaaatgttataattgtggaaaaatcggacacttcaaaaaagaataccgtcagacctttgggcagaagggatcttataatgcagccccccaccccagaaaaaatgccaggactttgccctcattgcaatataggaaataactgggctagtcaatgccactcaaaatttcatcagaatggcacccccctgtcgggaaacgagaagggggcctggacccgggccctataaacaatggaggcattccctgtccagcccacagccccatctcagggataggttcccggaggcacattgattccctctccccaggaacacctggaagctcaggattcgatctcccagtcagagaacaggtaacgttagtgggaggagacaaacccaccaagattcccactggtatttggggacctttgccaacaggatatatgggattaattttgggtaaaagctgtcttaatttacagagcattaccttagtcccaggagttattgattctgattatgaaggagaaattcaagtagtggtaatgtcacaaggtctttgggtttttgaaccaggagaatatattgctcagctactgcttattacctgccagttacacccttctttacggaggttgggagttcgagaccagcctgaccaacatggagaaaccctgtctctactaaaaatacaaaattagctgggcatggtggtgcatgcctgtaatcccagctactcgggaggctaaggcaagagaatctctggaacccaggaggtggaggttgtggtgagccgagatcgtgccattgcactccagcccaggcaacaagagcgaaactccatctcaaaaaaaaaaaaattgatattatccggtcctgaactcaccaaagggccatctgagcctgaaattttcttcgtgagaagatggcaaatgacaaattctatttcattaaaagatatagagctattccagttatctatttcttcttgtgactggtagtttgtgcctttcaaggatgtttttccatttcatttaacttgttgaatatattggcataaaagttgtttacgacacatattcccttattattcttttagtagctataaaatctgttgtaatgttacctctctcatttctgatgttagtaatttatatctttttcctgatcagtctaggtagaggtttaacagtgtttctgatgttttcacagaaaacatatctcatttcattgatttttccctattacttttgttttcgatttcattaatttttcattgtggtcttaatattatctgtgttctgatgtttgctttgagtttactttgatcttttttttccctagtatcttgagctaaggccattgacttgaggcccttctccttttctgatacagggacttagtgctataaagaagttccaagaaggcactggcagggattggggtctctggttaccagggaagggggtccctttggcctgtgggctgaaactggaaccatcaccctgtcatctgtgggcaacagactcaggcactgagctgtgcagagaaaaaaaaaatgtgcctagaaagacttaatcccatcctggagggagccctgggagccatggggtcattaagagatcccctcaatcccaagcggtccttcagggtcctatgagacctgtcttagtctactttttcttgcttataacagaatatctggaattgagtcatttataaggaaaaggaatttgtttcttacagttatggaggctaagatgtccgaggttgaggagccacatcttgtgagggccttcttgatggcagggactctctgcagagtcccaaggtggctccaggcacctcgtggtggcggaactgagtatgctaagtcaggtctgtctgccttttcttataaagcagttccattcccatgataacccattcatcctttaatccacgaatggattaattcattcatgggaactctgcccccatgacccagtcaccttttaaaggccttgtctctcaatactgccacattggggattaagtttcaacacgagttttggagggacaaatattcaaaccatagcaagacctcaggactcagacaccctctgtcacaggtcactctgagtgacagttaatttactcaagtgggacctcagggaccaggacagagcaggacctgagagacacacacgtatatacactccctcttacctgggttaatggtcacttgaactttgaccccaagatcaattccaggtctctcagtcccacaccaataactgtcagcatcatctcttttgagattctccatggtcacggtgaacacgtggtttttctgattgtccctgatggaaactcgattcttctttacctcctgctctgatccatttgttttaacaaggatgttacagtaattccaatcagctccttgacaccgccacttcaagtaggtctcccagcctgagccataagcacactgcacagtcaatgagccctgctccgagccattcactgttgttggaccagtgattttagcggcaatggagtaacctggaaaacgcaaattcatgtgtcgtcacctcccaccccaagggcagggccacagcctcgtgcattgggagtagcagccaaatccaactgccttataacagtcaaggaagcaatacattttcctcaagacaaatctttgtccttcaaaattccactgggtcaaagtcaccaggaaaatcactgaagagcacaactgcagatccccaaagaaacacaaatgttggcattgagcaataatagcttcctgcagttcacccctctctctttccctatggccagcaaatctttatattccaaggaatgctctttggcaaccatctttgtgttatactggtctgatggggaggaaatggcagaaggcccttttccagaagaatgattgctgccttgatgcttggctgttcctagtggttctaatggtttctggtggctctgctgtagttaatcaccctgaatgaatccctttgaaatcaaccaaatagtgatgccaactggtctctatctgctatgggatccacatcacacagatctccatttcgccatacagtgttataaattccacttccaaaattcctaggaaaagctaacttttaagataaacacaagtaaaggttaggtataaacagagcagcacccattcaacacccttctgcatcttataagttcttctctaaacataatggacatgattcaagtcagttaaagggtgaggaacgggcatacctaattagctccacttttcaaacaatttgatccaggacaagactagtctccatgaacttgtcagcctaatctttcacttgaaaacaattcaaaacagtggaaataccttaagtgagagctttgccagaaattctttaaattcaactgacctaaagggagacccatctaaagaaacgattgattttgatgatttatgcactggcaataaaccatagctgtgattagtgcagcataaacttgagatggaactagaagcacattggagcacttgaagaagccctgggggcaattcctgtggcaggagagaggttgtctctgaaacgccaagagacacccaaggtcgtgggtaagagctcaggctgtgccagagtgcttgggtttgaatcctggctctaccactgataagttttgtgaacctgggcaaattaacctctctgtgtgatacggtttgtctgtgtcctcacccaaatctcatcttgaattgtagctcccataatttccacatgttgtggggggcaccagttgggagttaattgaatcatggggcggtttcccccacattgttctcgtggtagtgaataagtctcatgagagctgatggttttataatgggaaacctctttcacttggctctcattctctctcttgcctgctgccatataatacatgcctttcaccttccaccatgattgtgaggcctccccagtcatgtggaactgtgagtccattaaacctctttttctgtgtaatttactcagtctcgggtatgtccttatcagcagcgtgaaaatggactaatacactgtgacttcgttttctataagtgggaatagtaatggcatctacctctatgttactatattatgtttgttattattattattattattattacccctggatgaatgaaaactttagacttcattggaatgtcttgaaaaaccagggtcaccatggtgggagcggaagacaatttcaccataaacaggcagagctccacaacccaaggaattcctggaacagaaattggactccatgcccaaatctgctttctatggcatctgaagggaactaagaaactacacacgacctcctggggaaagatgggtataggggcttcatttgttcactctgaaaaaagttctacatcagaatggaaagacaacaattaaggtaaatatttaaagaaaaactacatctggaagttatttataagaaataagagctgggtgtggtagctcacacttgtaatataacaactttgggaggctgaggcaggagaatcgcgtgagccctggagcttgagagcagccctggcaacatagcgagactaaataaataaataaatattagctgggtgtcgcaccacatgcctgtagtcccagctactcactcaggaggctgaggtgggaggatggcttgagcctgggaggtcaaggctgcagtgaaccctgatcccagcactgtactccagattgggtgacagagcacaccctgtctcagaaggaaggaaaggaaggagaatatatctgaaaattgtttacagaatataaatttgaagccaggcatggtggctcacacctataatcccagcactttgggaggccaaagtgggaggatcacttgagcccaggagtttgagaccagcctgggcatgaaagtgagtcctcatctctacaaaaaaaaaaaaaataaaaataataataataataataataatctattttaaaagaaaataaatttgagattggaaggaaaaattttcttacaaagcttgatctgagtatagataatatgagaagcacatagatttgttacattttaacagaaatgaaaacactacgtatcaaaatttgttgacatgacagccaaagctgtactcaaatataaatccttgggaaaaaggtttgatgcttcctcaaaaagttaaacatagaattaacataggattcagccattttacccctagatatatacccaagagaactgaaaacatatctccatacaaaactgtgctatgaaagttcataacattattactaacaatttttaaaaggtagaaacaaccctaaggttcattgacaaatgactggagaaaccaaatgtggtatatccactgtgaaatactatgcagccatgaaaaagaatgaagctttgatttgtgctacaacacaaagtaaccttgaaacatcatgctaagtgaaagaagcactccagcctgggtgacagagcgagacaccagctcaaaaaaaaaaaaaaaaaaaagttcttcaagaatggactcactcattagttccttccttcattgatatctgttcattcatctgtttatatggaacagtcagggttgagaaccactgttccaacaagaagctatacttgttttgttttgtgtgtgtttgtttctgcagcatctaacacagaacctgtcagataacaaaaacttgattgctatttaatgaatatgggcatggatggatgaattggcgctgtcattttccctgacatgtctccttcctgagaacagagcgtctctgtctccaagccagccgctgtcattccagtgccttaaagctccagccacactcacctgggaggatgagaagcagcagagatggggacagccacatggtcctgtctcctctcctctccttggtgatcacaggtgtctggtgcccttcagggacttgaatccaagctcggaagtcaacaccgcaaacctactcgaatctccttcaagtctcttgctcacttcctgttacatctgtagctacttctctttttacatattaggagaaaagaggtgtcattctttgaaaagactaaggtacagtgtatgttgcaaggtgtgcccaaacttttgtgcatgtggaaaagaaaatgtgtccgggactggtcaggtttgcacgggagtgcacgtaggagccaaggagcaggaggagccaggaggaacccaagcattgaggagctgcgggatctactgcctggaggagaggacggacaaggccagccatgaggagtgcagggagaggagcactttgggaagaccacagtgcacaggactcacacccagccttgctggagaaagcccatgccccaggcttcttccaggcagccccactgtaagacatctcattgcctcttcctgccctgggctgtctgacccactgccccttcccccaggaacacttccactgggatcatgagtcactctgaagccactctgaaatcactctgaagccaaagctgggctcagtggggaaggtcaggaatggagaaattgccttttctcgttagcctcctcttgccctgatttcatcctccctatccctgcacactttcccctggctgctgttgtaatctacttgttctgctgacgcccgaactgacttctttcccggtctctccccactttctttagatggtcccttccctctttctctccctttccctcctgaatcgattcattttttctctcctgttttatattttccatatctgtgggctttgttctacatttggggagctttttatattgtttatttcatgcttgtactttcccttccaatccttggatcaaatattgattttagagactgtatttttatttcgaaaagtttttttggttctttgattactgatgttttcaaactctcttctgttccttgaactatatccctccactcagtggtcacatctttgttttgttgtctgcttcttctatattatgagccttcctcaagtgtctgctgattcttggttatccaatcatagttgagaacaagataaagtgtagctaactgagacctcagagtatgtaggagtaaatagtatataaaatagctctggtggctcatgcctgtaatccagcactttgggaggccaaggcggacagaccacctgaggtcaggagttcgaaaccagcctggccaacatggagaaaccccatctctactaaaaatacaaaaattagccaggtggtggcacacgcctgtaatcccagctactcaggaggctgaggcaggagaatcgcctgaacctgggaggtggagattgcagtgagcccagattgcaccactgctctctagcctgggcaaaaaaactagttccaaaaaagacacttgtacacgcatgtttatagcagcacaatttgcgattgaaaacatagggaaccagcctaaatgcccatcaagcaatgagtggataaagacaatgcggtgtacatatacaccatggaatactattcagccacaaaaaggaacaaaataatggcattcacagcaacctggatggagttggagatcattattctaagtgaaataactcaggaatggagaaccaaatattgtacatcctcacttataagtgggagctgcgctatgaagatacaaaggcacaagaatgatacaatggattttggggacttaggggaaaggatgcaggggatgagggataaaaaaccatacattgggtacagtgtacactgctccagtgaagggtgcaccaaaatctcagaagtcactgctaaagaccttatccttgtaaccaaaagccatctgctccccaaaaactattgaaataaaataaaatataaaaagaaagagaaagaaaagaaaatagttccaatttatcatgcc

SEQ ID NO: 375 - DNA, 13876 bp, Homo sapiens
  source 1..13876: mol_type = genomic DNA
tagacacacaataaaagtttattgaatgaatgagtaaataaagggaaaaaagaaaggaagaataggggaaaaaaagggagtaagggagaagggaaaattcaaagcatggagaagccactgtttgtttctcctgcacctgctgtctgccatctgtctactctttcttaactcttctcttctggcttctgctgtcattgctctgttgatctgctcttctgaacttcattagtgaccttgtgaatgataagttcaatagcctcctctcaatcccggtcctcctccacctctctagctctgctctcctccttgaaacattcatggctcttgacttctcatcttccacctgtttgattctgctccagcaccttgatcaatgtcttcctcctaccctttgtctttaaatgcaggtgccccgagggctctgtccttggttctgaactcttccctccatgttttcacttcttgctgggttccagttaatctctctacacacattcctctccagccctcaacactctgctaacccacatctctagctatctgctagacctctctgcctgatgattccaaacacacagaaaactaagctctgcatcatccaagcctgctcttgactttcctacttctgtcaatgatgcccgattcctctggttttccaggcttaagactccggactcccagattcttcctttcagactttgctacatctgctaggcaagtcctcctaaagcacatctgcaatcccatcttgttctgctcaaatccatcccaccatagctaatcaaagtttaagtaagagttgagtcctaagcctcctgaacctgccaccacctgagttcttctagattagttccatctggcctgccacaggaaaatttcactccattggaatcttagacacatcctaccatgagcatctgtatgtgaacagtacagtccatttgctgataggtcttctataagtgactattgttatgaagattatttcccgcctctctgctttcacttatgctgtttctctgtcctctctctctccctgttgctccatccctgctccgctgaaatcctatacctccttcaacatcaacatgaatgtcaccttctttccctgacctggccagcttggcatgatattctcctcaccaaccccctgacatcaggaagcatctcttgtggctctagagttcttcctatgctgtaatgacttgggagcttatccttctcataaaatgaatcataagctcctttcttgctcatcatcatatttcccgggttaatataattaatatgggccttgttagattgaatttctctttcagcatgagtcctgggccagccccatctttcccctagtcaccatgcatgatggagctgggagccccaccagagctcaagttcagagcacggcagctctgcctaagcactcggcactcagagggtcactccatgtgctctggacactggcatcactagctcaggatgagctcaggcctgggggcagagggggagcactggtccagatgtaggtagcaagtggagatggtgatgcttgcttgtggcagactgtgggagtcctccccacaaactttagggaaacagagtaattgacaaacattcagaaaaccaactgagctcattcccgagccaggggtcaccagtagtggtgatagcactgtgcacttcaagtgtggacaagtatccttcacctctgtgccctccatcctgtctttgaaaaacgatatctgctctgcctgtggaaaaggttaattgctaacaggtggtctcagccagacttctaaagtggacagaactgactctgttgaccttgtgcattggacacctccaggtgggggaattccaggagtgatatcaggggcacccaccagctccttctccctttactgtttcaactcgccccagaactttaacctggagcagctcatccacggcccacccaggcagagatgttctgagcccagccacacactgcctggttacagggagagaaggggccttaaagccagggagacccaaggggcgtcagaagacgagaggagccctgagcatgtgggacactgggcaactgcatgagcaagctctgccgggaccaagctcccttggggttgtcccagagaagagatggagctctgtgagcctaaaggctggggctgtgaggggtgtgtcctcagggagactcctgtctgcaggaaggaggtagttattgccctgggggaaactggcctgagaagcatttgtgccaagaagaatgaagggccaggctcctccagaaaattttttccctcccttcctccgtccttttctctctctctctctctctctcgctctctctctctctctctctctgtctctctctctctctctctctctctctctctgagacagggctctctatgttgcccaggctggcctggaactcttacgttcagccgatcctcctgcctcagcctcctgagctgggattataggcactcgctatggtgcccggccaacttccagggaattcttgcccttgggaagtgggcatgagggcagggaggcaggggactggggaggagaaaggaggacccccaagctgcacattgaggactccagaggagtgtcctctaagagccaggaccctcctttgaggcacaggaacaataaatccctccagagtccacaggtctctcgcatccagtctgaaaggttgactccctgcacggggcactcctggggatggggctctgcagggcttcgggtcagcctggctctatcttccaggaggagcccactgaggcctgttcacccagaagacagcacccagcatgctcaggagcaggggcagcttcagaaggaccacgagcaggaagtgagggctgctgagccggaacctgtggtggacacggtgaaaatgagtcacttccccgggagaacccccaggacccttctctccccacctctccccatgctctgactctggagcccaaataacccaggagcagccagggaaaggacctatgccagggcagccccttctgtggcccccatccctccttctccctccatcaaggactgcccggggggtctcatcaaggagaggtgatggagtgaagacagaagagggacccacttccaggagtgcgctccacagcaccctctctgtccctgtcccactcacagcctccactttatcaactgacttcttaaaaccagtccccactctcgctttttttattttctgagacagagtctcactctgtcacccaggctggagtgcagtggtgcaatcatggctcactgcagccttgacttcctgggctcaagtgattctcccacctcagcctcctgagtagctgggactacaggcgcaccaccacacctggctaattttgtatttcgtagtagagacagggtttcaccatgttgcccaggctggtctcaatctcctggactcaagtgatccaccgcctcggcctcccaaactgttgggattgcaggcgtgagccaccacacccggccaccactctcactgttccactccagctccttgttccctcccctcagggtctagcagcaatatcacagccctttctggatatctttgggagaggagagagaactgattcaaaccccagcctggagctggcccatctccccacagaccccacagacagctcctggtggcaaaatccccagctgagcaaagacctttgaaaagggccacagaactgggaccccaagtccggagctggatggggaaggagacaggaaggagtggggaagggaggaggggctgcacgtccacctgaactcaaccttcgacctgagtcccagtagctgccccatagggaaaggcgttcacagcacaagtgatatttcccactcagcatccacatgcagcctcagagagtatgagaatcaggaccagagatggagagaaacagcagacagtgacgatctcaggtcacggtgcgccacccccaccccccagcttccaccccagggttgctccctccatggcctccaggccctgcgtgcttaccctgaattttgggtcaacacctccccggtgctgaggtttcgcccagggttcaccaccaggaagatgggaggtgtggctggatgtgtggtcctccttggggttgtaattgctgttggagatgaaaatgatgcatcagccgtgcctgggctcccagccatgcacagaacacccgtatggatgtcatacagaatcacccactcacagaagaggctggaaagatcttctgaagccagatccagggcacctcctgggtgaaacccctcagggacaaaaagagcccttaccagaaccagccatgagagtcccctccaataagtgccaggtctttctctgcatctcagagaaagactcttaccactctgcccactctgccctcatcccactctgcctggggtgagggcaggggtctctctgggcttccgcagccagatgtggagttccaggaggaggaggggaaggaggagtctaaaggaagatggctcagcctgtggcccaagaagcctcgtagagaccatgagagggggctctgagcacccttcatgtggacactcttttttttttttttttttttgagatggagtttcactcttgttgcccaggttggttggagtgcaatggcacaatctcagctcaccacaacctccacctcccgggttcaagcgattctcctgcctcagccacccaagtagctgggattacaggcatatgccaccacgtttggctaattttgtatttttagttgagatggggtttctccatgttgatcaggctggtctcgaactcctggcctcaggtgatctgccctccttggcctcccaaagtgctgggattacaggcgtgagccaccgcgcccggcccatgtggaaaggccactgtaggccacccctagggaggggataggttgacactcggctcctcctaaggacttcaggtgaccaccagactattgacatagtctactccctcattgccactggactcccagctcatgatctccctaaagcagttgtcctggaggctcagcccttcaccggtgcccgacacaggctcagtgtgatccgataagccgcgttcaacctctctgttgctggagattcgttgatggacgtggcatgagccccaccccgttggaggggcagagacacataaacagacggactcacttccgctggaagcagccctgggaaggagccccagcaggtgcaatgggagcacaggggagaagcctaatccacccccaggccagcagtgaggaaaacatgggcggcacctagcagaggcgaatgccggaccatgggatgcttttgggaagtgagagacatgatagagtgtgagtctgaggacaggagatggtgtggatagctaaggggcagggggcaggggaatttggttcaagagggatggggaggcagaaaaccacaggacaaggagccagccccaggaggatcacccttgggcaggatggggaagcctgtcctcaacccgaaagggaaaggggaagaatgagtgtagattgcatgaaagtttgcaagtggagaaggaaagaaactgatgtcctgtgtgttctcaggaaggtagatgtatgggagagtaatgttggaaactcttaacttctactggcagccacaggcaccattttctcactttttttccccagcagcgctagagcaggtggattttagacagggcgaccaactttcccaggacttttctagccttagcactgaaaatcccacatttgggaaaccccttagtcctgggcaaactgggatgattagtgacctttattttaggattgatccagggatgagggttttgtcaggtagataaggaaatggaatatgggagttatgagtgctgctaagagaagaaaatgtcaggctgggcatggtgtctcactcctatagtcccagcaccttgggaggccaaagcgggtggatgacttgaggtcaggagtttgagacctgtctgggcaacgcgggaagatgctgtctctactaaaaaatacaaaattagccaggcatggtagtgcacacctgaagtaccagctactcagggggctgaggtgggaggatcacgagcccaggaggcggaggttgcagtaagccgagatcgctccacggcactccagcctgggcaacagagtgagaccatgtctcaataaaagaaaaaagaaaatgtgatctattgcaggggctcaaagtggtctaggaaggaagtgaggtcagaacgggagtgatgggggcaataaattggcggaaatggagggatcagaagacagaaggtcactgtgaggttgagaatagggacaatggcatgaggatgggggagagctgattgatgaaaagttgtcagaaaatagaatgtctgagtttaagactctgggcagcgaccaggtcgggtgatgacaagctctgaggtgtttccatggggtgcaattctgaagagagtagaaaataaaggacaccaaggttgagaatgtcaaggaacccaaggcaagattgccaagttattcattaaagcctgccaagataatggcagaggttggagtggaggcactggcaggactccgttgaatgagggggagcagcctggaagctgatggtcggccttgtcaagcacaggtagagggtgggcatggccatctggcacagcatttaaaggaagcaggtggaaagtcatagggcggaagttgtgatgtgggcaggaagaattgggacacggctccatggccctctagcatagggggagtaagagaaagagtagcttccactcaagaagctactaaacaggaaggtcttcccaagcaagacatatttcaaaacaacatggtagggggatgttctgtgaggaggctgcaaatgtacaggagtgtttcttctttggtacaggcttcccaaagggcacggtggaaacagctttggctcagcatgaaggggcctcctccacgctggataatggggtgaggcccaggccctatgggagtgatggcgcctgagctgtgcaccccccagcccacccaaggctgaaggatcagccgcctctctccatgcccatgccataggctcctcccaacaccactgtgactgaggacaagacaagacttggacgcacacttcagtgtgccgcccacccttgttcccttgtccagtcgcaccccaaaccctgctgccaaagtgaggggagctcttacctggggaaacatacaccctaaccaggtccgagggatcgcgtgaccatgaatccaggacccacactgtctgaattttgcaccagtaagatccagcatcatcttcattgaggttctgcatggtcacagtgaaggcgagagcctccgggtggtctctgatggacacgcggccattcctctccaccttctcttctcccttggtctccacaatgctctcacatgacgtgtcgtactgtcctcggcaccagtacttgttatatcccttgtacatgctctcatactgacaccacactgtcagagagtcccccgcagtgccagtcacagagccggggcccttcagagacaaacagcctggaaaacacaagcccgagtcccaagtctccatccagatggccccatcagcagccgtctgtctgaagcttaaggggaagattgccagggagacctgggtgtttcctgggaggggaacctggaggaatacttgagcttaggacctaagccaaagagtccctgtgagagcagaaacctgtcccctgtgagagcagggacaccaagtcacagcacaggggccccagcacctggagaccaaagctggaggcaggagcagagaggagctggtcatcccacctcgtcctgggccctgcagcctctgccaggcatgagatttggtcatatacaagatcacttccctttggagtgagacccatatattctggggtcttctgaatctcaggcttattctttaaaagcacaacttgcggtttcctccactttcagagtgttcttgtgggaggaaaaatactctccggctctgatcttaaccactctccagaaagaatcaacatggcactgggaagaggggttgtccccaaaggaagccctgataagcttctttacctgaatttgggacacaagatgacccccccgacaatagtccccaggtcttgggagtcagaggtcaccatgcattcagaggaaagagggaagctgctctctgtaaccaagtgaggtgatttgggtcctgggaggaaagtggggtttagaatctgggaggcaaagtgtgagaagttgatacggaagcaaagagaagggacaagaaaggctgtaggtaggcagaagttcaggcattatgggatgtgatgctcagcagagccccccaatatcttaagcaagtgctgaaaaactgacaagaggctttgtttgaacttgagtgtatgtgcatgtgcacgtgtgtgtgggtgtgagagagagggagagaaagagaaacagtgatgaggctgagctttgcaccccctcagagtaacctgagttcacaataagaggatgaatacgcgcaggggccacggaagcttaagccgttagaatgagcagaaattgtgaaagagcccctggcatctgtgggtcctatgactatctgggctcctgagctaactacatctagatctgaggtgattgaggatggaggagcccctgacttctggctttcattcatttccctcccctcctcccaccatctgcctttcctccccactctgtctgcagctggctctgtctgtcatatgccttggcagatgtgtgagctgccaccacgcacaccttcctcaccccaccaaccatgcttggcctgagacaatctcactgtcactatctcttcccaccctcctggtcccttccacactcagtagcacctgtcacccccaccctgaccccttcccagcccctaccccaaaccctgctccaaacctgtgttttcccgctctgtgctcccttgaccacagcaaagtggctcctgaccccgcaccttctgagcactccccatttctctgctgtcctaattctcgtaagaaccttcctcgctctggatgctgtgccctcaggaatcttcccattcccaaatccctgctccccacctacgttctcccccaagaacctgttgccccgcagctgcacacccctcctgagatttgagagctggtcctcacctcctcccttccacctgcccccagcttcctcctggaggtggcacatcccagcagcacctccttctaggttctggacagagctcaggactgcatttcccacagtgggagcttggcagggtacaaagggcttgtcacagccaagagtctggtgatggagccggggcctgcttgtgctgcttcctaaagggatccttgctggagagcttggggttgttcttcttctgctaggatcagagccagtcccttcagagctgaatgtgtcctagaattcctgccactccaatcaagaagatgccagcagcagataggaagtcagactcaagagagctttccaggctccttccagcccaaaaagtctttaattcctcaattgcgtaagagctggcctggccttctgcccctggcctctggaaagaggctttctcctctggaatctgtcctccactctcctgattacaacctgggctccttcagccctgctaggaagcaaatgtttcactcctcctctcaatcacacacacacacacatacacacacacacacactggggagagcacagctgagggaggaaaccatgggaccattttgtcccttccagagcccagagccacttacttttagctccctctggactgagctgtttccttccccaggtctctattgggtaaatctccaggtttggggggtctttctggttcacaaactttacaacttttcaagccattctaagccaagcaaacatcagtccctttgaagaggcagaatctcatcctgaaaagcctaaaagtgctattgggaaccccaaacctagcaaatctggaaggtcaccctagaaaagaaagggccttctgcattcatgatggctattctctccagtaggcaaccttctcattgaaatgaaaccaattcaaattaatcttctgaaaagacagaagatggttcttaaaatgtggaaatcacagctgggcgcagtggcccacgcctgtaatcccagcactttgggaggccgaggcaggcggatcacaaggtcaagagatcgagaccttcctggccaacatggtgaaatcctgtctctactaaaaatacaaaaattggccgggtgtggtgcctcaagcctgtaatcccagcactttgggaggccgaggcgggcggatcaccagaggtcaggagttcgaaaccagcctggctagcatggtgaaaccccgtctatattaaaaatacaaaaattagccaggcatagtggcgggggcctataatcccagctgcttgggaggctgaaggtgagaatcacttggacctgggaggcggaggttgcagtgaacctagatcacgccatgcactctaggctgggcaacagagagagactccatttaaaaataataatcataatacaaaaattagccgagcatggtggtgtgcacctgtagtcccagctactcaggaggctgaggcaggagaatcacttgaacctgggaggcagaggtttcagtgagccaagatcgtgccattgcactccagcctggcaacaaagcgagactccggccaaaaaaaaaaaaggaagtcacttgtaaagacttatatttcagaggtagggcagcagtgtggataagagtactatctaaagcccagtaagcaaagccacctccaaaatggaggtaaagcaaggcaacttgcagaggggagagcctggataggtgagcttaaagaaaaagataaaggccaaggtgagcggatcactggaggtgagaccagcctggctaacatggtgaaatcttgtctctactaaaaatacaaaaattagccaggtgtggtggcatacgcctgtaaccccagctactcgggaggccgaggcacgagaattgcttgaacctgattggcggaggttgcagtgagccaagatcaccccactgcactccagcctgggtgacagagccagactccctctcgaaaaaaaaagaagaagaagaagaggaaagaaaaagatgagataaggggtgtggctgattaaatcacagaccctcagatgtagagcatggcttatggttgcttagcccaattttctacttaatgtaaaaatataacaaaagcaaattttcatgcaaagtattggcagatgacaccaaattactgttgtttgaaagaagaaccaggactggattgggaaggagtgggtagatccatgctgttgataacattctagttcatggattggccagtgagctcacagatgtttgttaagttacatataattaaaataaaagagggtcttgaatggaccagtgatgagagagtgttccatgacccatgatctaattctgggcacctgaagttaaggaaaaagaaggttatgctaattccaagatactttcctctgtcctgctagagtgttacctgaatgcaagattagcatttctcaaggaaatccagcatgttcctggaaataattgatggaattatataaatgcgtcggtgcatttgttgaaacatgtgcttgctggttgcttgaggttaatgggagctactaaatattggacagcaatcagttcagaatggaaataccagatgatgtggcagagaggtcagctattttgtcactattactaggttagccttattcttgacacctccatggccaatggaaagagctctgtggaggacacagatctggacttcatttccagcttgtctacttagttcttatgtcatcagatctcccttcatcatcttatttataaagtggagtcaatgctatttgccctgcctgggtcacaaaactgctcagagggttaaattctatcatctatttggaagtgtttataggttataaaaatgtgtaataaatagaattctagttttgctctttttaaattttttacttttctttttttgtagaaatggggtcttgctatgttgcccaggctgatctcaaactcctgggctgaagcattcctcctgctttgacctcccaaagcactgggattacaggtgtgagccacctcactcaaccaacgtttgcttattttgtatttgaatttgcttccttcctctttgtcatttcccctccctgctagaattgccctttccatctctctttcccagttaagattttcagagggacctgcgcaggtcacattgcgagtctgaggatggggaatgagataggggtggaaagagagatggaaagggcaaagaaaaaggaagcaaattcaaatacaaaatgagcaaacattggttgagtgcagtggctcatgcctgtaatcccagtgctttgggaggtcaagagaggaggattgcttgagcccacgagtttgggtccatgtcacctacctggtcttcttcctttaaatcgctgtcattttcactcacccttctagaaagaatcttgtcattacattgggcaatttctatgttttgtgagggaactcaaccataaaattcattctgcaaacatgaagaatgtcctctaatttttagcctaaatttatttccccagagacaaatgtgttttcctgcagttttgtattttgaatgtctattaataagagtttctcttctgaagtccaacctttgcaggacagtttcatttacttgtttacaccacaccttgttccgggaaggatttaaggtagatgttgaggatggcatttttttttttcagacaggatctcaactctatcacccaggccagactgctgcagtggtgcaatctcggctcactgcaacctccgcctcccaagttcaagcgatcctcctgcctcagcctccctagtagctgggactacaggcatgcatcaccacgcccagctaatttttgtatttttagtagagacagggtttcaccatgttggccaggctggtctcaaactcctgacctcaggtgatccacccaccttggcctcccaaagtgatgggattacaggcgtgagccaccacgcccagcccattaattatttctcacaaaccattccaacccctttacactaagcttcgtcaaaacagaactattgttaattcttgaactctccatggtctttaatgtcctcacacttgcacataagctattcctttcccactcagccaactcattcatcctgcaggatggacttccaatgaagcctcagtgacatctcccacccttccaagagcaaagtgaggggttcctgttgcatactctcatcaccacatgaatgagtctctacaacagtaatttccacattgtattgtagttagttgactccctcagttcagaagttactcttaattacagcacccagaacagtcctggcacatatctggtgctcagtaagtgtttgtaggatccgtggatgaatgattgaatgtatagaaggatgcacaggtgaatgaacggatgtatctttcccttttctgtggacacttcacctctggtttgaacccaggacagctcttctacctactgtcctgccccctgcaaaaccaagtccccaaagccacagccccactcacctgagaggcagagaaggagtagagctgggagcagccacatgttcctgtctccttggcttccgtcctcagcaaatctaggtcccagctggaatccaagtatatgtaacggagcctgggtcatccactttctacttgtccaagtttcctttgtgttctcactcatctatttcctctttt

SEQ ID NO: 376 - DNA, 76219 bp, Homo sapiens
  source 1..76219: mol_type = genomic DNA
agctgcgtggtgacggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataaggtaaacatctcctgtattcctcaacctaacgttggaagaggcgccagcaccaggagttttctccactcccctgactttgctttgggacttaatgagaaactagcttgtatctgtgagtctggggagccctttctgtctgatcctgtttcctgctcaaaacagagatgcgtgagctcttggggaagggctgccgccagaggctcagatggtcagaagcttcattcattcacttacatcatctgtgttcctttttcaccccctccttctccttgcctatttatgcccctgggtgacccctggcaccttgctctcctaacccttgtaggagactgcatttctccctgttacatctgctagcagtggccaaatacctgaatttctggccaatttgtctgaaattagataaatggtctgcagcagagatgaactgctgttttcaaatcagactccctcatggctccagaaagcttccctccagccatgattccctcacagcccctgtaagcatttgcttatttcaaagcactaacatatccattgcttccttcactcaagtttcttatgcaactcagttttcagtaatgcaggtctccccctaagatagttgttgggaaaaatagtagcctctctcaggataacagttttaattcaaaatccatcactctgaaataatcaaagtgttatatttgccataagaagttattatggctcaccttccttttctctgactttgccatgccttcctgctccagcccctatattttctgctttgataatgccagttcacctgctagtcctttgaaaagctgtacgtgatcctataggtggagttttttaatcaaaacatcactttgaagagtctatgaatgcaagctttgaaataacctaacccaacctcctcctctatcacccagcttatatttgaggaaactaaaatccagagaggaaaaatgacttgtccaagaaagcaagctggtaaatggcagagctgatactaaaagccagaaattactactacacgtgtagtattctttcctctatatccttactaaacttctcatcaaagtgtgcagtccatggaccagcagcattggcattaccttggaacttattacaatagaaagccctgaccctagattggctgaatctgaatctgcattttaacaagatctctaggaataaatatgcacaataaagttttaggtgcatggctctgtgccatgctgcctgtttctgacacaaatgaaagaaaatcagctattgaaggaagcaggtctctagatctgacagtccatgtgtcttctccctccaggtctctgaattcctaggatatagagaaggagaaaaaatgtataacaactatcccagtctagaaattttaaagccatcacagtttgaagtaaactagaagaaattctgtgctatttgatgttgtcaatttagcccagtaaaaactgcatgcaaggccaggcatggtggctcacacctgtaatctcagcactttgggaggccgaggcggtggaccgcttgaggtcaagggttcaagaccagcctggccaacatggtaaaatctgtctctactaaaaatacaaaaattcgctgggcatggtggtgtgcgcctgtgatcccagctactcaggaggctgaggcaggagaattgcttgagcctgggaggcagagactgcagtgaaccgaaatcacaccactgcactccactctagcctgggcaacaaagcaagaccttgtctcaaaaaaaaaaagaaaaaaaaagtttatgcaagcagaggaacataattacaaatcaattacaaaattttcctggcaactagatatgtgggtctctccaagtttataccatcctataaaggtataaatactcattttgaaagctttaagattgggagctcagattgttcaaaatattgatcagatgtggtattttccatttcaattacccacacacgagatgtaggatgtagtccatgaagactgttacttcctttgagtttattgatcaccaaattgagagtgggaacccattccaacaagttccaacatatttaaaggcaagtatctatttactactagtaaaggctcaatgtcatcagcttggctgtgtgagcaccctgagagcaggagccagccttaaaccttctgtggtgcccagcagagtgacatatgtatgtaaggaaagttttccttcttatatagtgctgacaacctcctcctaatactactttatgattgtgcatgatgttttattgtgatccacttaaaactctttttgtaaaggggtagggcatcaacttatttgtattatattaaaaattactatgtagtagagtccaaggagttcccattgattgattagtgtctattgtccatgagaagcagggctcccctccaacattaattgctaggataaattctttttttgaagtggggtctcagtctgtcacccaggctggaatgcagtggtgtgatctcagctcactgcaacctctgcctcccaggcaagtgattctcccacctcagcctccccagtaactggaactgcaggcatgtgccaccatgcctggctaattttttggcagttgttgttttgtagagacagagtttcaccatgttggccaggctggtcttgaactcctggcctcaagagatccacccgctcggcctcccaaagtgctggcattatatgtatgagccaccatgcccagcgtggggaaatgattttttaaatagacttgttattgacacataacaaacaccactttgggaagctgaggcgggcagatctcttgaggtcaggagttcaagaccagcctggccaacatggcgaaactttgtctctactaaaaatacaaaaatcagctaggcgtggtaacacactcctataatctcagctactagggaggctgagacaggagaatcacttgaaccgaggaggtggagactgcagtgagccaagatcacaccactgcactccagcttcagcaacagagcaagactccatctcaaaaaaacaaaaagaaatatgacaaacaccaaaaaatcctgaatcttatgtgtctaccttggtgaattatcacaaagtgaacatacctgtgcaatcactatcaagagaaagaaatagaaccttgtcagcttcccaagaggccccctcccacattccacttgccaaacaccctcccccagagattgtcattatagaggaagaagcatcatcttgtgttttgacagcacagcagatgttatgtagggtagtcctagaaacttgccagagaagagatattgtcgtatgatgaaacgaaactccaggcttggaataagccaaaccttgatgtgactttgagcaacatctgtgagtcttaattttcttagctataaaataggaatgataatacctgccttattatttttgagcaaggatgttagcgaatataatgtaacgcgtatatataaaatctctggaatataggaagcattcaataaaagtggttgtattggctgggcgcagtggctcccagcactttgggaggccaaggaggatgaatcatgaggtcaggagatcgagaccatcctggccaacatggtgaaaccccatttctactaaaaatacaaaaattagccgggggtggtggcatgcacctgcagtcccagctactcaggaggctgaggcaggagaatcgctttaacctgggaggcagaggttgcagtgaaccaagatcacaccactgcacttcagcctggtgacagagtgagactccatccgaaaaaaaaaaaaaagtggttgtattagggcatgcatcttgggctccaaagcagcttcaatgggtgtcacattcagtctcacctaaaatgatgagctttgtgagaagagcagcagcttcatacaagagaatctcagaaacacacacactacctatttcacaggcagaagtccatggaaataaactcacacaacccatctatacaaaaagcgtgacttctatgcaaacatcccagttctgacttcctaagttgagtatcttttttctcttggaggtggtgtatgggacttgatgaaattcatttatatgaaaaacatacgccaaatatcatgataggcattgtgtagctcttgcactttagctggtcccaatagttggaggctgacccaggcaagcccaagtaactcttagaagattcccgtagggtgggctggaagctgggaactgactgaaaacattgagctcatccatcatgtgcctggagtttttaaatagagttgttgttgccacaaatctgaaaatttggtgcagctaaataatttaaaacaaaggagcaacctggctgctcttttccttagagaactctcagttctctcttgccaccagcttcaagagccatccagggcaatggtctggggtaggggttcaggaacagcccacggattgggtccctactgtgccagggtctgaccttgagctcccagaaaatgaaaagattttcatttcattttcacagagagggcaagcttttgccccagataccagtgaattaggacaaaagggcttcagttcaagcacttacttcctaattccctatcaccagggctctaaggaacatccacataccagactagcttccagagggacgaacaattcctaggacaaagtcagtctcagaaagactgggggtggggggcagaaaaacgtgagctgctcatccattcatccagggcttggttcttcttgggtgaaaagggattaccaggtctctgtcttccaaagtatgtccatttcctccgactgctctaacacctcttctgggtgaaaggaaaaggcaagcaggtaatatctgccactctcccccatctcctgcacttattcttcacttccttcttctattacccatcttgtaatttctgtgtccctcaaaagtccgcatgcctcatcgattcattcagcaaacatgcattggacatttccaaagcgtaaagaactaggctggtcattgtcgagaatatagacgcaaatgattcccaccttcactaagcctgtggcctagaaggcatgcacacaaatggctatacttttatataattccagaagtgtcctaagaaagatacgggtagctgcaagggagtgacccaggaagaaaaggtcatgtctgactgaatttgaaatgtcctctctcacttatggcttctgattaaagttaacctccaggcttggcacggtggctcacacctgtaatcccagcactttgggaggctgaggcaggtggatcatgaggtcaggaattcgagaccagcttggccaacatggtgaaactcgtctctactaaaaatacaaaaattagtcagccgtggtggtgcacgcctgaaatcccagctactcaggaggcagaggcaggagaatcgcttgaacccaggaagcagaagttgcagtgagctgagatcacaccattgcactccagcctgggtgacagagtgagactctgtccccccacaaaaaaaattaaaattaaaaaataaaaaataaagttaacatccatgagagacagagttccacacatcagctagctccctccccatgggactgtcacctattaatcctagggaaaggtctggatacaacagtgttctccttccctgccagaaaattgtacaagagaaagacaaataaaacagcaaaagaccatactcgccattctgtgttcctctctcattctctatcccacaggtgcttcttttatttttttttcgatgaaacaatgataatgataatggtatgcaaatttgtcctcaaaagaatccaaattagcagaaaaatccatgccctgtaagtgaagagagttttgttttcaaagcgcactagttccaattctcaaagatttctattgtcagctcaggaacaaacaagaaagccaagaaaagctagctgctccctgtataatatttccactggcttgttttcctctcttgcttgctctgaaggcttacagataaacaaatgaagtgtatattacatcactggcaatctggtgccgtctgggactcctttggctgataggtcggtcctgcccagatcccagagcaggcagctggtgtggggagtggtggtgcctgctagttctcttaggataacctcagcaggaaatgatggtgactcagtccagcgcctcaaagtcgttttccaaactctccaggctttcctctcctaagcatcctttcctttaatttgtggtccctggggccttttgtgagaaaatgtctgagactcacttgtgttgctgccctaatgtttcctcttataagctgttctagggagggacgtccttcagtttcagggcaggaaactccgccttactgggtggaagtaaacagccagaggtgagcaccaggctggagaattgttgaagtgggcatttgaagtggctctaaatttatcccaatacccttcttgcttccttcctcctcttctcaggcaagagaaacagtctgtagagactgcgagtgcgaatggagatcacagctccttgttaactcactcaggcaatgtagttcccagctgggagtggccctggacatcctcctatctcttaaccagaggaggttttctggggccaagagagacagctccaagcaaacagatctggaaaatattaacccctaactgatgacaccaggcctcaccctgctcctaaagggagcaaggccttgagtggtgcagtgaaaataacttgagacgtgcagggctcaagaattctcccagcacatggttcctgaccttgatttctaagtcagctccctcccttctcatttgcttatcagcgccttttcatttgcttattagcaccttctcatttgcttattagcagacagtttctacccatcaacatgaggatgctatttaatcatttgtgcttttgcaaatgcacatgcttttaggtatctgaaaccaagctgtgcttaagttcaaattttctcttacttgctagccttctgcccctggccaccacacacacagacacacagacacacacacacacacacacacacatgcctgcacatgcacacatacgcacccttcctctcatgagctgtgggcagggccagtgatcatccgtttttgttctctgtctccccttagcttttgttatgagccttttaaaagcaaagcaggctgggtgcagtggcttagtcctgtaatcccagcactttgggagtccaaggcaggcagatcacctgaggtcaggagttcaagatcagcctggccagcatgaggaaactctgtctctagtaaaaatacaaaaattagctgggcgtggtggcaggcgcctgtaaccccagctacttgggaggctgaggcaggagaatcacttgaacccggaaggctgaggttgcagtgagccgagatcgcaccactgcactccagcctgggcaacaaagcaagactctgtctcaaaaaaaaaaaaaaaggcaaagtaaacatttctcctcctcttcttcctccctcgcctgtttgaattttgcattcataccctctcccagcaactctgtttattaaaaatcggaactgtcatttattagagcagtacccctaggggagagtcaggaactggtaacaccttccccaagctcacagtgagaagcagtgtaagctttggaagggaataaagtctggtacacagtccagatgaggcagacaccccctttcagcccctggagtctccctcctcgcctcccccatgcctttacccagatccttcctccttctctgggtcccacctcaggtttcatttggttatcaggtaagaaatattaaaaatcatctctgcactataatccaaagggacccagtaagactaataattgttcccaatacattatccaaataagcatatggtttatttctgcagcactttacagtttgcgaaacactttaatatatgccaagacattttatacttaacatatgctttttccagaagatgttactattaaactaattaatgtccatattaataggacagggaaacaaaggccagatggctgggcatggtgcttcatgcctgtaatcccagcactttgagaggctgagatgggcagatcatgaggtcagtagtttgagaccagcctggccaacatggtgaaaccctgtctctactaaaaacacaaaaattagctgggtgtggtggcgggcacctgtaatcccagctactcaggaggctgaggcaggagaattgcttgaacccaggaggcggaggttgcagtgagctgagattgcgacactgcactccagcctgggtgacacagcaaggctctgtctcaaaaaaaaaaaaaaaaagaaagaaagaaagaaaaaactgacttgctcaaggtcatagccagcattgtggaagcctgaatcattacagcagacccttagatagcacttgcatgccatgtaatattctaagcacttagcatctcttaactcacttaatcctacaacaaacctattttaatctcattttacagatgagtaaactgaggcatggagacattaagaaatttgcctatagtcaaatccaagcaaggtagacaggcagagggatagagtcaggagaggacaaggggcttcaccaagagggtcacagatggtcactactttagggcattgacagcagtccattgtgtggccttcagctctgtagagctggttttgctcactcactcaagagtggctccatctctccagtcaggctgatgttaatcagactcacaagacatgtattgccctagatgccaagccacattataatcaggagatttttttgttcgctaagcatgaaatccaggggaaaaaatggaacttggaggattcaaatgtttaatgctatcaggctgacatgagttggtagctggctacactataggcacagcctcaatctacgaccccactggccccttctacccttaggtcctctcccctaccccttgccccacctctgcctccctcagctgtatatatttaactgccttgggccggacagtcattctattctctccaggtctgtatttcctgcaatcctttaagaactccttgcctttgagcttgagaattccctggacttgacctggttatggggagggaaagggaagggatgttccgttcatcatcgccagagttgtcatttcatacttcttcctccatctcactcaaggcctgtgtcagagccttagggacttggatttcaggggcaagaaccatggaagagtagaaaggtgattggggacatttccttataccccaccaccacccctgttcacatgctccccttgaaatctgatatttctgcctgagaatcctgagaatcaattcagcaaatatttactgcgcaccacatgccagtccccaggaacaaaacccactcttcattccccaaggagctgcgtccagcaggctgggtggatcagagggatggcacaggcagagatggctcaggccacatctgactgcagctcagtgtgccacgtggaccttggtgcccatgaaggtcaaagacctctagtcccatatagtgggaagctgagcccttggggaccaggtcaaaagcttgcagctctcgaggctgccaacttctggctcctggctgattgacggatctgaggggttataaagcccaaagtcccaggatggggccccacctctgaaggtcagagggctctgagcccctcaacacagggatcccttcaagcccatgtccaagaaaggaagagactcctgttgcacttctgagaagtgcccagtgcaaagacccctgtccaattgtggcagagtccaacacatagaaactaagctggatcccttccatgaccatctccaaagacatgggctgaaaaacactcaaccaaacccaaaacaccaggatcccagcccttgggatgacagtgtggcacacaaagagaggcttgggaaaacagaggggcacgccacgtgagctctgcaggcatgtcctccaggaccctcactctcctttccctgaaaccaggtctcctccagacagcaggcacatgagaaccagcatagcataggccctgaccatcacctgtcctgaccaccacctgtgctgtctaccacctgtcctgttcaccactggttccatccaccacctgccccatccatcacttgttctgtccaccacctgtcttgtctactgccttccctcttcaccctcatcctgttcactacctgccctgtccaccacctgtcctgaccaccttctgccctgctcactgattttcttagagtaggaggcagctcattagcagagaaagagaactgggctttgagtaccaaagaaccaagctttatccctgtctctgctgttagccagctgtacattctaggtcattccattccaacagcactttccaacttgcagaaaacttgcatataaatcatttcggttgaattccccagcactgtgtgtaaagagaacaggcattattcttgactgcaaaaggggaaatcttgtgatcaggactctcgatttccagtgacaaaacccaactcaaattggcttaagccgaaaagagaactcattggttcctgtaccagagaagcctagggagtgcagctgacatcgagctcagctggtcccagggactctcagtgacttcggcctcactctctgtctctctctctctctcatttttctctctggcttggctccattcacaggcaggcttctccccgtggggccccattattgacagcagccccaggatcacatcctcacagctcccaattccaaacaaagtcctagacccaatactcactggagactgaaattgccacatgcccacccctgaaccaatactatagccagagggtagaacatgatggacggcttaagctcgggtcacatgtccaccccgaaggtggagtcaatcccacccaagccctgtagatcaagagtggaagaaaatgggccgggcgtggtggatcatgcttgtaatcccagcactttgggaggtcaaggcgggtggatcacccgaggtcgggagttcaagaacagcctgaccaacatggggaaaccccttctctgctaaaaatacaaaattagccggttgtggtggtgcatgcctgcaatcccagctactcaggaagctgaggcaggagaatcacttgaacccgggaggcggaggttgcggtgagccgagattgcaccattgcactccagcctgggcaataagagcgaaactccgtctcaaaaaaaaagagtggaagacaatggtttccagggaaaatgggatggtgtcatctggaggctagccatgcaaaaacaacagatgtcccatggtaatccagggcaaggctgagtcccagcattttcaaatctttaatgagaagtgcctgaaaagaaatgaagagaacttgtcacagtcccacctgaactggcctcttggtgcctcacacatagtgtcatttaagactaaataactggatttgggttattaatgactggacttgggaaacaaactgctgtcaccctatgaagcgataggcttattggggctgcagagccagacctccctctatgggtgggagtagaattttctctgaaggaaatagatgatccaactgtggaccatccagggaagaggttgattggagcagggaatgaggattcaggaagctgacggagctcagacaggaatgaggggaagctcttccgcctctcttaaggaccatggttagctgctatggagacgcctgaatttttccattgctgtgtagggcgtgtcagcccagggctacatgaacacagatgagaagtgaggcagaaaagcaccaaacaaggccaactttatgagtatgccacctacaaagtcacataacgccctgcacttagaagggccctgcatttggtttaacactttgcattcgccatctttaaagtcttaataatgtttgtacaaggacccctgtatttttattttatatagccattcttgctgccagataaaaacccctgcaaggtctgagcctggctctgtggggtagttttgagctattccctggggcacctctgccttctgatggcctcacaccacgcctggttttggatgtgcctcgagtaaccagggaagagtcatcttatgctttgggccagatggcaaaggagtgggcagcaccacagtggcattcactgtcgaggggtggttgcgtccccaggacagcatctgcgagggtcacgggcagcaggaagtgtggcctggaaggcagatcagacagtccgaaggtgggtgggtgggcaagtcctcaggggtaagtggctgtgacagaggcaggggaagaagtagacagggatcatgtttgtgatctgagcattgtgctgaaaaaacaataagttcatattggtggctattagtgaataatgagagtcattattttatttatttatttatttattgagacgagtctctctctgtcaccctggactgcagtggcatgcactctgcctcctctgcctcctcactgcaacctctgcctcccaggttcaagtgatcctcctacttcagcctcctgagcagctaggattacagatgtgtgccatgaagccctgttaatttttttttttttttttagtaaagatggtattggccaggctggtcatgaactccagacctcaagtgatccacctgcctcagtctcccaaagtgctgggattataggcgtgagccaccacacccagccaagagagccattattattaatatatttaattgcaaaatttgaaaaatgaaaaacaaagaaaaaatttcctgtgatgccagtgtttcaaaatacatatcttaaaaataaaaatggactgcgcacggtggcttacgcctataatcccagcactttcggaggccgaggtagctggatcacttgaggtcaggagtttgagaacagcctgaccaacatgacgaaaccctgtctctactaaaaatacaaaaaagttagtcgcgcatggtggcgggtccctgtaaccccaactactcaggaggctgaggcaggagaatcacttgaacctgggaggcagaggttgcagtgagccaagattgtgccactgcactcgagcctgggtgacagagcaaggttctgccttagaaaaaaagaagatgaaattgccatgtaaaaatacatgcatgtgtttatttatacatatgtgtgagatagatagatagatagatagatagatagatagatagatagatagatccatcataggaattttgttatacacatttttaccttcattctttttaatcactacatagaattccattgtatagataagtgaaaattcatggtttattctgaaattttgaaactcatagaaaggtacaaaaactagaagaacaaaaagaaaatgacacatgtacctaccatctatatttactaaatgctaacattttgccttaaaaaaaaaaaaaaagaaggctcctataggtagctgggatccactttgcaagatagccatgggatagaaggttaattgggttactttgtttttgttttgatatggagtcttgctctgtcacccaggctagagtgcagtggcgcgatctcggctcactgcaacctctgccttctgggttcaagcgattctcccacctcagcctcccaagtagctgggattacaagtgtgcaccatcacacccagctaattttttgtgtgtttttagtagagacagggtttcaccatgttgaccaggctggtctcgatctcatgacctcaagtgatctgcctgccttggcctcccaaagttctgagattacaggcgtgaaccactgctccaagccctagtttggttactttgaaatcacagcctgatgggtctgcggcacttttagttacactccatttcgtagaagagaaaagagatctgagagacattcagtggttgttcaagggcactcagcagggaataaaagagaaaccccaatccaagcttcaactccagaccctaactcttctccttatccctccctagattcccaaggtccttaggaaagggaaggcttggactggaagctcccccaaacccctttatcactgacctccagaaatgctagtgaagcccaggtgacaatctcagcctggcccaggataaacaccaaagcaaaatcaatgccagtgggagatattcattcacaaagtggattcaagaccctgcgtgcagagctgctcagatgaagcaggcccaaatgcagttagtcaccgttaattgggtctcaggagtggaggagcaaacaacagcatcccctggggatttgcctccatcaacccaagtgcagggtaagaagcccaggaaagcaagccaagctttgcaagcaccagcactgcccctgggcagactctccttcactctatctccacgttctctcccatttgccctcatatcttgttatattttttttttcttgagatagagtctcactctgtcacccaggctggagtgcagtagtgccatttcggcttaccgtaacctctgcttccaggttcaagcaattctcctacctcagcatcccaggtagctggggttacaggcacacgccaccatgcctggctaattttttgtatttttagtacagacggggtttcaccatgttggccaggctggtgtcaaactcctgagctcaggcaacccacacgcctcagcctccaaaagtgctgggattacagacgtgagccaccaagcccggcctattattattatttttgagatggagtctcgctctgttgcccaggctggagtacagtggcaccatctcagctcactgcaacctctacctcctgggttcgagtgattctcctgcctcagcctcccgagtagctgggattacaggcgtacaccactacacctagctagtttttgtattttttttagtagatacgaggttttgccatgttagccaggctggtctctaactcctgacctcaaatgatccacccatctagccctcccaaagtgctgggattacaggcatgagccatacaaccagcctcttctagtattttaagctgacttactgtacctacatctccactggttctttcccttgccacctgccagacagctggatgttacagtgcaaggatgcaaggtctctgggtcgcagtccttctttgcttattattaattttgcagaggctgtgtgaagtttgaaataagtgcaccgtctgaatttcacaactctttccactgaactgagggaaggcaccgggcagtatagctgagatcagggcctgtgacctgttgcttctttgtcgtggaaaccctctgcgtcattgatagagggcagcattctgcatgtaaatgccaacaagtgccagtgctctgctctgctcatagcagatttctactacacaagggtgcagaatgtccctcctgtatttctgaccttgggggacagtctttcccctcccttaattctgagcccctcctcagaggtaccttcagaaaaacaaatgagtcagtcaccttttctttttatttattcagtttattttatttatttattttatttttatttatttatttatttatttatttgagatggagtcttgctctatctcccaggctggagtgcaatggcacgatcttggctcactgcaacctccatctcccaggttcaagcaattctcctttctcggcctcccaagtagctgggattacaggggcccgccaccacacccagctaatttttgtatttttaatagagatggggtttcaccatgttggccaagctggtctcaaactcctgacctcaggtgatccacctgcctcggcctcccaaagtgctgggattacaggcgtgagccaccacacccagccaagtcaccctttcttgatgcaagagttgcagaccctcaggacagagccatgtgaggatatggtcacagtggactactttggggaaggggcttgtgctggggcagggggaatctgattgcttcaagggtccctttcacaactactggagagctccacagctctcattagtgacaaccttcatcagcctccaaacaaagagggtcactagaggccctcaggggaagcctcactacaccagcggagatgtgatggagcgggtccatgcctggagaacagtgtgaaccggatccatggctgccaattctcagtccatacctaagtaccagcccctgacaagtaccaactgatgtgtaggaaacgatacacacacatcagtagatgttggcataaagttaccaactgtcctttcttaggaaatactgtctattatcctgagacttggggtgctcaaagctcctttcttttatgaaattatggtgacaatggattgttgaatagaaactttgttaagcaacccctcacttaaccaacttattaggtcaaccaatacccttcagtctcttactggagcacactgactaagcctgaggcacagagtgctcacagctggcaggctcttctctgctctcacagttgtggtacctggttaacaagaatgcatttgggcccatacttgcttatgctggtcatacgtgttaactagaatgatgtacttgaatcaattcacctgtaaacaaaggaattggccgggcgtggtggctcacgtctgtaatcccagcactttgggaggccaaggcagggggattacctgaggtcaggagttcgagaccagcctggccaacatggtgaaaccctgtctctactaaaaaatacaaaaaaattagccaggcatggtggcaggtgcctgtaatcccagctacttgggaggctgaggcaggagaattgcttgaacctgggaggctgaggttgcagtgagctgagatcacgccacggcactccagcctgggtgacagagaaagactgcacctcaaaaaaaaaaaaaagaaaagaaaagaaaaagaaaatacaaaggaatttaaacagaaagactattgaccaataaaataagagtgtaaaaaaaaagagaacggttatctctacaaaaactaaactgctttggaaagacactataaaagcctgtcactttttaaaatgctatcaaattaggaatgaatgagagaactgtaaaatatcggaaagaaatgcataaaaatgaagaaagattttgcaatcaggtggcttcataagtttctagaatttcttgcttcatgttaaagaaactggaactgaaaccccaggatcatgtgtgtgtggtttgtgcttcaggaaaggcaatgggccccacttttcagcagacttgtaagcaaagcaaaggctttaggtctacatcaaaatacttgctaataactacacatttagatattttaagtcaaaataaaacatgtagaggaaaaatagccttggcgcagtggctcaaacccgtaatctcagcactttggaaggctgaggcagatggattacttgaagtcagttcaagaccagcctggccaacatggtgaaaccctgtctctactaaaaatacaaaattaaccaggtgtgggcgagtgtggtagctgacacctgtaatcccagcactttgggaggtcgaggtgggcagatcacctgaggtcagaagttcaagaccagcctgaccaacatggtgaagccccgtttctactaaaaatacaaaaattagccaggcatggtggcacatgcctgtaatcccagctacttgggaggccgaggcaagagaatcgcttgaagtcgggaggcagaggttgtggtgagccaagattgcgccactgcactccagcccgggtgacagagcaagactctgtctggaaaaaaaaagaaaaaagaaagaaagaaaagaaaaaatacagtatatctcttttatgagttccgggtttaacaaactttttcaatgaactgaccaattaccaattcctgtgaaattgaataagaatttacctacttggttcagacatatttgactttggcaaagaaaactgaaaagctaaaaaaaatgtgcctacttggtagaataaaaggctgatcactgtatctgtccttgccaatctaaaaaatttattggtacatgaaatcaaccgattccagcagtctcccctttccaaggctaagcagctttgagctctatttttcaagatgtcaagcaaaggtagcctttcacctcacttgagtgcaaatttatcttactcatggattttggaggttgccaactcagtagtttttttttctccctcaactactctcaaacagtactatcttctgaaagccaatgatatgcacatagttctcaaaaggaggctgtccaaagcttacaggcttatcaagtggaatcttttttgacatgaggcctcactctgtccctgaggctggtgtgcagtggtaccatctcggctcactgcagcctcaacttcctacgttcaagcgatcctaccccctcagcctctggagtagctgggtctacagtcgtgcacaaccacacccagctgattttttatttttggtggagatatcctttttgtaggcctccctatgttgctcaggctggtctcaaactcctgggctcaatcgatcacccaccttggcttcccaaagtgctgagattagaggcatgaaccacgatgcctggcctggaatctttaaatattaataattcaaaaaccaagaagggaagccccagcaactttagatggctataaataattaggcactcaatcaggattgagtgcttagaaatcttggagtttgttttaacacaatgtgctttcctggaaatcatataacaagatagtaaatgctaccctcactcagacctgaggaaccatatttaagatggttcctcttgcaataaacgtgctggccagccacccaaattctgccttagcaaagtcatgatggggtgcggggatacggctgagatgacacccagatacaaatctatagacattatgaaacaatttcctttcctgcctcttgcgtatatctgcctccctcctctcgccccagctacttctctagcactctaaactctagctcaggcttgagcaaaccgggctggattagcagctgactcctacagtcatagcactgcacagagagaacccagacacttcctatcaggaccacaaggcagagatctgctctgtccagctctggaattgactggactggctcatgactgtcaacctatttctgagaacataaaaaggtccctttcagactgccaccaattcagagggctagaattttagataaaaacagtatatccagtaatctgttctctcttgtagacacttcctcgtttttttgagacagggtctcgttctgtcaccgaagctggagtgcagtggcatgatcacagctcactgctgcctagaactccagggctcaactgatcctcctgcctcagcctcccaagtagctgggaccacagacgcctggctaatttttttaatttttttgtagagatagcaatcctcaagcaatcctcctacctcagcctctggagtagctgggactgcaggcgtgcgccaccacacccagctaattaattaattattgtaggtctccctgtgttgcccaggctgctctcgaactcctgggctcaatcaatcacctgccttggcctcccaaagtgctgggattagagttgtaagccaccatgcctagcccagaatcgttaagaattaataattcaaaaaccaagggagggaaaccccagtaaccttagatgggtttatcacgttgcccaggcttgtctcaaacacctggactcaagtgatcctcctggctaagccttccaaagcactgggattacaaacgtgagccaccatgcccggcctgtagacaccttttttcaaagtttgactaaggcaaccaaaagggatcagaatggatcggtcttcccatgctgtttcactgctcttcagcagcccatgtccaccatccagatgaaggtagaagcagcccaattcctccagccaagccaaattgagctaaattctagtcttccctgtgcgtctagcttaatgtcagaagtttcatggcaataatcttcactgggatctatgattttatattaccagaaaagatgaatccgtttctatccaacataagcatatacttatacattctgggtagtgctggctgcttgaaataaactctgaaataaatccactttatgcacaatagttgaaatggcacagttacgctctgatctaaggccttatgttatgccatttttttttttttttttgagacggagtcttgctctgtcacccaggctggagtgcagtggcgcgatctcagctcactgcaagctccgccttctgggttcatgccattctcctacctcggcctcccaagtagctaggactacaggcacccgccaccacacccagttaatttttttgtatttttagtagagacggggtttcaccatgttagccaggatggtctcgatctcctgaccttgtgatccgcccacctcggcctcccaaagtgctgggattacaggcatgagccaccgcacccggccatgttatgacttttattcttataccttgactcattctaatttggctctgctttgaacttttccattttaagatctctctgtgggcgcttcttgctctgtaaatttaaaacagtctgtgtcaaaaacagtctcactctgacctgaccagcttagatgactagctcaagaatagtcaagcttgcttgggctccatgaagtcccccagagcggaaaagcccttgaaattctagggaatgatctttgaggtcatgggagcaggatctctccaccaaggtcaccaatgccagatgcccttggggtgtccatagctgtgagaagtcaggcaaaccccaggacacattgatatggactgctaaacatgcctacagcctcctacctgctgggtcaccggcctgtggtgctcagggatagctcgtcatctcttcccaagccatgatgcctttccctgacactttatccccagcccctccctacaatccccccatccaacaaaaatcaacctagatgaagtgatagacctttgtcctccagccagaggacatcgtagcccctcatctctcctcaattttcaggagaggaaaaaggagtctgtccacgtcatgcttctgggcagtcaatcctgaaattccttaggttgtttggcccaggactgccctgccagaatagtgaacaccgctgcctgtgctctgagagatgccttctactccaaatacactgcttattcattgagtcaaccaataaacatttgagaacccatcatgtgccagacagtaactaggcacgggggatatgggagtgaatgagacaaagtccccacttaaggcaccacacagcctagtggagatggggaaaatgacaaacacagaccccactacataagtcatttcaccaaaggaaataaagcggagcaacaagacagagagaaattggaggtgggctgcaggggccactgccccctaagtggccaaggaaggcctcttctaagaggtaacatttaagctgaaatgtgatgataaaaaggagctaactattcaccagtctgcgggaagagcattctggaaaggaggaatagcaaatgccaaggccctaagaagggagcaagccttatcttgttagaaggacagaagaaaagctggtgtgcatggagcagagcctttgagagggagggtggatggagttgggggtgaaggggcagccagcagcccatggatcccctgagaacttgcaggctgggagagaaaccatcagaaggctataagcagggagtaatcaggtctgtgcttggaaaagatcactctggttgctgggacgagaatggactccatggcagagaatgaaagaggaagaccaggcagggaatggttgcttggactagcaatcattgtgggcttggtaaccacagagatgatgagacgtggtggggttcagggtactttctggaaggaaggctgtcagattgctaaaataaagataataactctgtctgggtgtggtggctcacacctataatcccagcactttgggaggtcgagataggcagatcacttgaggccaggagttcgagaccagcctggccaacaaggtaaaatcccatctctactaaaaacatgaaaattagccaggcatggtggcaggcacctgtagtttcagctacttgggagactgaggcaagagaattgcttgaacccgggaatcagaggttgcagtgagccgagatctcaccactgcactccagcctggggaacagagtgagactctttctcaaaaaaaaaaaagatagtccagcatctgtaaatgagcatgatccctgtgtgagcagcagtgtatgtgtatacacacacacacacatgcagacacatgcacatacacactatcctccttatacaaacagtgcagactccaggctctggagtcaaatgtgttcaaattccaactcatctgcttacttgccattaaacttggttcaagtcactgaacctctccatccctagggttctctgtctgtaaaaaggggacagtaatagaagtgcctcatggttgtcatgaggattaaattagttactacatgggaagcatctaaggaagggcaactgccacataccgtatgagtttcctgttgctgctgtaacaaattagcaccaatttcgtggctcattaaaaacaacacaaatttattctcctgcaattctggaggccaggagctcaagatcagtttcaatgggctcaagtcaaggcgtgggcagggctggtttcttttggaggctccaggcaggggaatccattcctttccctttctggcatctgaaggctgcggcattcatggcccctgctcacgtcacacccacgtccacttccatcatcactttgtctctacctctttgaccttctggcctctttcttatgaggacccttgtggtgatattttgggcccacctgaatcagcaagaataacctctctatctcaaagtccttaacttacatacatctgcactgtccctttctgccacagaaggtaacagtcacaggttctgaggattaggacacagatatctttgggggccattattcagcccataacatgtggtaggcaataaataaaggttcattgtattacgataatggtacttcatgataataatgataacatttttctcattatcatcttcatcattcccatgaaagccccagagcatatccctagccccctcctcaactatgtaggagaggaggggacgtttagaaaaccccaactcctagaagccccctgagacttggccccaagcccaacccagagctaggggcaatgctggctgatcaggcagaggcaccagtccccgggttggtcctgatgaggggagcagggggcagacggtcgatgaggcaggagtgtgctcacagcctggggtccaagaaggagcctggagtgcaggctaaggcctgctgatggtgctgtattccgtgggctcctcagggcccctgccggggaggtggctactgaggtggcccatgttgcagtaggtcggttcctgatcctcagcacccaaggtcagagatgcataggaaatgtcctccttcggcaaggaagcctgcagcaaaggcgggctccaggtcagagaggacggcaggaagtgacggtcacggggcagaggagccctcggaggaggatagtggggatggaccattcagggcttctaatcccactcaagccctccagcttcccccttcactctgccaagcaccctgagcttcaaccacaacagaacagattctcccccaaccctgcaccagtgcagcacatttcctgtggaatcccaagtcactcagcctgtctgggactctgctgcccacgtggggactgtgtttgccagtccctgtgtccccaggactgagacttgcctgtgggagctcctaggcgagtcctgcagtgactatggctttgccccacacctgcctcctctatgcccacatgagcaggagaaagcccaccctccaacggggtgcaacggcaggcctgtgtccccctgccccagcctcacagcagcccccatggaggacgcaccatggtgacatattccacttccacctggtcaacctgggcagaggaaagcttcgtggtagccttttgcggggaggttccggccagctgcagggtcaggtctgcatagcagaggtcgccctccaggggctgcagtacctgggacagggaacacaggctggggagtcacaagatctgtctgtggacacaggttccttttccacggtgggacgggacgagagcctctccacttccccaggtgcccctctcccatttccctccgtgtcctccacttctcaggctcctgtacccctcagcccttgtccccctggctgtttccaggccctcagcccccaggccctgcagggtgccatgaggacaggatactttggcacaggacttctctgatattttggaccttctgagagatggaaaatgaggaaggggaaagaagctgcctggtctctctggtccgaccttgggggctatcttacctgctctggggacatcccggctgctaaaagacaaacaacaattcagaattagaaagcccattccccagactcacaagaacccccaggtctagggaagagaaatatggaagaaaagaggtgaattgggtccaggctcagagacagggacctggttctaattctgattcctcagatgacacagtctgtgacattcgtcatgtcacctctctgacctttcacttctccaccaggaaaagagggacaccccagccccctgctccccacatcatagaactgtgcactcagctgatcgggtggccctgccagccatcggctcccctgggagtaagtttgcttctgcagaatcccaactcggcctggaattccaccatgtctctctacctgattcatccttcaggggtcaattcaaagtcatgcctgccttctgcagctacccaggctgtctaatccccctcccgggcccccggggggcacttgctctatgtctgtctcatcatcttcgtcctactgaattctagttagtcctcaggtgggctgtaagctgcagggtggctgggcctgtcccttccttacaacctgggtgcttggctgtgctgagcaggtggtgctccatcagtaaaagttgtctgcagagacaggaatgcaccaagctgtcccccaaccccgagtagaatgtgcaagctgggtcggcacagtagggaccgattttgtttggtttggtttggtttggtttggtttggtttggtttggtttggtttggttttgagatggagtttctctcttgtcacccatgccggagggcaatggcaccatcttggctcactgcaacctccacctcctgggttcaagcgattctcctgccttagcctcctgagtagctggaactacagatgtgtgccaccatatccagctaatttttttgcatttttagtagagaaggggtttcaccatgttggccaggctggtctcgaactcctgacctcaagtgatccacccgcctcaacctccctaagtgcggagattataggcatgagccacgacacccagagattggattggattgtttttccactgggaccgattttcaggtggttgctggtccctgtcttctttctcccctccccagccaccagccccacatccctgccctagggacaacaaagaaatggggggttttcccctggtttcaaaagtctagatgctggagaacacagaaagcacttagaccttaggccgtgggcaatacatttgggagaaaaagcgatgaataaaagtcaggctctaattttgaaaaagcatcacagaaaacaaactaacagagagtcaggctcccctcttcccaggcgaaagatttcccaggctgtggggagggagaagtgttggagggaaccctgtgagagttaggacccagctgttctagaagagaaagaggtacaattgtgtgagaatgtggaagtgaagccacattctcacacaactggggttttgttgaggccaggcctcatgatctgtgagtgtagactcctgcgccaagaggctcctccctgaagagctagttcacaaagggcaagtaggtcagcctgggaaagtccagtgggcaagggagggacagaaggaaaggccattccaatttcctgatcagacttggagggctgtgtgtgtgtgtgcatgcttgtgtaatgtgatgagtgcacatgcactgtgggatccatgcagtgtgtgtgcccatgatcgcgcatgtgtgtgtgcatccactggtgtgtttgtgtctgtttctccctccccattccatgtcagctcagtacctccttgacaaccacatagacccaactctagcgtctagtctagacaccccagactggaccacccacctaagaccattgccacctatgccatcaagagtcaatccaggaaagagacagggaggtggatcagagagaagagaaggggaaggacggaggtgcagggcaggcggcgaatgccaaaacctcctggggctcccctgcaagctccagggcgccccccggtcccctggcactgccagctgctgagggcctttgggactgtgccatttcctgattgtgtgggtaatcccttggaccagatagctcccagatgccacatccccagccacccggcccagtctcagcccagcctcacccaggtcctctcacctttctgctggtacttcatcatcctccaagccaagagtgaggcggccaccaaaagcagcagcaatatggtgaagatgaggggcaggaggacactgagcttcaggagcttgtgcctagaaacaatggcaagcgtcccctgcatcccaggctcaccacctgcctctcagcccaatcccacccacccagcagcaggggagggccacacacctgatgagctgcaggtctgtagtttgcagcctgggaaccctcactcctggggatcctcaaagatgggtttacaatgagtacacatagacacaaagaagggaatggaacaagagacaccagggcctacttgaggatggagggtgggaggaagcaaagaatcaaaaaactacaaactacctattgggtactatacctattacctgggtgacaaaataatctgtacacaaaaccccggtgacgtgcaatttaccgatataacaaatctgtacgtgtacccctgaagctaaaataaaagtttttaaaatttaagaattttaacaaaagatagttgtttttggttttctttgtttttcatttttttgacacagagtcttgctctgtcacccaggctggagtacagtggcatgatctcggctcactgcaacctccacctcccaggttcaagagattcttctgcctcagcctcccaagtagcggggattacaggcacccaccaccacacctagctaatttttgtatttttagtagagacaggattttgccatgtaagccaggctggtctcgaactcctaacctcatgatccgcccacctcagcctcccaaagtgctgggattacaggcgtgagccacagcgcccggccttaacaaaagatagtttttaaaaggagaaaagggttccatgaggtggttttaatgtgtctagaagcctaacagaaattgtagggcagcagactcctaaaacacctcctgcctctacacctgccctctctactgggttgaatagcgtcctcttcccctcgaattcacatccactcagacccgtgaatgtgacctatttgtggatgtaatcaagttaagatgaggtcatagttgattagcatgggccctgatccagcgactggtgtccttacaagagggaaatttggacacataaacacacacaggaagaagaccatgagacgacagagacagggatcagagtgatgccgccacaagaccgggaacacaaaggatcgcaggcgcccaccagcagctggaacagaggcatgagacagactctccctttgagcccccagggtggcaacagccctggtgacaccttgatttccaattcctggcctccttagctgtgagagaacgtatttcttttgctttgagccactcgtaacggcggccacaggacactgacaggccctactgtagtggatcattgccacagcagccggggggcctgtgaaccaaacgtcaaagcacacccctctctttctcaaaattctgcaacaggccaggcacagtggctcatacctgtaatcccagcaacttgggaggctgaagtaggcaggtcacttgaggtcaggagttcaagaccagcctgaccaacatggtgaaactccgtctctaccaaaaaatacaaaaattagctgggtggggtggcgtgtgtctgtaatcccagctacttgggaagctgaggtgggagaattgcttgaacccaggaggcggaggttgcagtgagctgagatcgcgccactgcactccagcctggtcgacagagcaagaccctgtctcaataaataaataaataaataaataaataaacaaacaaacaaacaatcaaaataaaataaataaataaataaatcccgtaacagccccatttcagcccatgaaaatggccagggctgacaatggcctccactcctgcctacgactcacccctgcctgcttcactccagcctcacttcctgctgctcctcaaatattccaggcacatccccacattacggaccttattccagttgcatttttctccaggaacatgctccctccagagctctgtgtggctcactttctcacctcttccagtctttgctcaagaatcactcgactgagcgcggtggcttacacctgtaatcccagcactttgggaggccgaggcaggctgatcacatgaggtcgggagttcgagaccagcctggccaacatggcaaaaccccatctctactaaaaatacaaaataacagccgggtgtggtggtgcattcctgtaatcctggctactcccagctgcttgggaggctgaggcaggagaatcgcttgaacctgggaggcgtaggttgcagtgagccgagatcctgccactgcactccagcatgggtgacagagcaacactccgtctcaaaacaaacaaacaacaaaaaaaactgttgtgggctgggctggattgtacaccaccacccccccaccccaatccatatgttgaagtcccaccctttagtatctcagaatgtgattgtatttgaagataggatctttaaagaggtgattgaggttaagtgaggtcactggggcaggccctaatccattatgactggtgtcattagaagagatcaggacacagacacacgcagagggacgaccacgtgaacacataggaaaaagatagccatctacaagctgagaagactcagaagaaaccaaccttgtggaccacttgatctcagacttttagcctccagaattgtgagaaaataaatttttgtgatttaagcccccattctgaggtattttgttaggggcaacccaagcaaactaatataaggattatctccttcatcactggatgtgcagaaatttgagaaagaaattcatcagtcaattaattgtgtcaaccctatttggttacactaattagctctagattgtaagtacctcgagggcaggcattttgattatttggtccattcttgtaccctttttaattcccttaaacagtgacaggctagagtgagtgctcaagagttatgtgttaaataaatgagtgaacaaaccatctcatgctaatcaaaggccctaatcgggcacttacataaggcttcgattcataaaataataaataaataaataaccttaactattacttattcaaagcagtttggtagaaaataaactttcaaatcagagggtatcctgtattgatttgcttaggaaaaagaaaaatagggacaaagcaaggtggcttatgcttttaatctcagcactttgggaggctgaggtgggcaaatcacttgaggacaggagttggagaccagcttggccaacataacaaaaccccatcgctactaaaaattggccgggcatggtggcttacgcctgtagttgcagctactcgagaagctgaggtatgagaatcacatgaacctgggaggtggaagttgcagtgagctgagattatactactgcactccaacctgggcaacagagtgagaatccgtcaaaaaaaaaaaaaaaaaaacaattagctgggtgtggtggtgggcgactatagttcccccagctactcaggagactgaggcatgagaattgcttgaacatgagaggcagaggttgcagtgagccaagatggcaccatgcactcaagtctgagctacagagcaagactgtctaaaaataaaaaaaaagaaaactttaaaaagtttaatttaaaaaaaaaacagaaggcaaatgggagagggggagtagaagggtctcaggtggttagaataccggggacctcccatagggattttgtggcaaggtcccagcaaaaggagaacttggcacttggcagatctaaaaacaaagtcaagagggccaaggagagtgaaaggaagaaattaaaggggacgttcctcttctagaaagcccagctgactgcagatggttgggcagggcactaagaggcatgacctgagctatggtgtagagcccagagacttccatccaagctccagcaccacccttcactgaggaagggactgaggctcagtttcttcttctgtaaaatgggaacatttgtatctgcccattcttccacatggggtggttgtaggaaaggtcaaagaaaacaaaataatgcacaggaaagccttttgtgagctgtcagttgctctagagatgtgagaaactataggcatcactgttcttgccataatagtaatcagaggaaaattaagggaaacaggacttccccaagccctcctttccttgtcctcccagaagttgaaccaagagtcatccctgcggctccatgaccccacgcccacactcacatgagacacactgtcctcactgactgccaactcatcggtctcccacactgagctccacggggacagtccatgtctgtgtccccagagctcagcacggtgcagccatgtagaagttattataacacagtaaaagtggggcgaacgaatgaatgaacctacaaacagcactgagctgcagaatgaaggatctgtggagactgaaaggacaccatgtggcctgacagcaagtgggaagggctcccagcttcctcatcctcaccaaggagcatgcaggtcccagacaaagctcaggctggaaaatgggacttcaaagagttctccattggaggagtttgggccaagtaggccacagtggaaccagagctggcttacctgttgtccaagtggtggccggtcagagttggggagctgctagtttcttcttgggtgactggtgctgtaaacgtagtggaggtaggcgtggtgggggcaggagtcgacgctgtagttgatgcttggtgtataaaccagatcacagatgcccctgcccatgagcccacccgcagccctgcacacagctctgagcctgggcgggggtctggactgctactatgggaaggggctgcagcctggaccactcatgtctccctggtctctaggagactccagagcctcataggcaggtggggctgggcagggtccagggaggacgctgagctggccctgggagggttagagggggctgggaagagcctaagggcagctggagaccagctgaacttgagcaacctgctgcttatgacagtgccttggtcaatctccacccccagccctatttatccagcaaaaacaggagcagagtgggaacttgcacagtgaccctagatctgtgacatcaaaggtcaggaccagccctgaatgaaatcatcatattcaggaagaactttgactttgggcaagttacaaaacttcaatgatggggatgcccccttctcaggggtattgtgaggacccattgagacaatgcacgttcagcactttgcaaactagaatatgccccagaggctccgggtgcaacctggggccccaaggactgtggtgctccttccatgccacaagggccctcgagccatcctgcttatcttctgagggacagcagaacaagcccaacaaataaacccatgcaaaccgaggcactgggacccctgagctaacgctcccaggagtgtctgcattctagaaggacataggaagaaatatcattaagtccacacacacaaatggctcatggtgggatgtcagggaccaggaatgcagccgtttgactgtgaagacctttctggacttgggaattagaccccagcaccccgactatgctgagcctctttttcccccaggttagatatggaatgggagatgggaacagcagctatgaagccccagcccagaactccaccaaaagcaggacacacctgggcaccagaggtctccaaaaagcaatggcaaggactggggtctctgggtaccatgggaaggcatccctttggcccatgggctgaaactgggaccatcaccttgtcctcaggcactgagctgtgcagaggtaaaaaatgtgcctagaaaggcttaatcccgtcgtggagggagccctgggagccatgggggcattgaagagaggccctgctcccccagtcccaggtggtcagtcagggttctatgagactcgggactcaagtgatagatcactcagtgacaattaaatcacttgagtaggacctcagagaccaggacagagcaggccctgagagacacacacatatatacactccctcttacctgggtcaatggtcacttgaactgtgaccccaaggtcatttccagttttctcaattccacaccagtaagtgtcagcatcagttttcatgagatcctccatggtcacagtgaacgtgcggtttttctgattgtccttgatggacacccggtccctcttcacctcctgctctgacccactggttttaacaaggatcttgcagtcacgccaaatagctcctcgacaccaccacttcaagtaggtctcccagcctgatctgtaaacacactgcacggtcaaggagccccgctccaagccattcactgttgttggaccggtgatttgagtgacaatggagtagcctggaaaacacaaattcatgtgctgtcacctcccaccccaagggcagggccacagctttctgtttagggaatagctcccaaatccaagtttcacaggttaaataacagtcaaggaagaaatacaccttccgcagacaaaacttttgtccttcagctttccactgggtcaaagccaccaggaaaatcactgaagagcacaacaacggatccccccaaaaataaaaatattggcataagcaataataacttcctgcagttcacccctctctccaccctacggccaaggtaatctgtatatttcaaggaatgtccttttgcagccatctttgtgttagtccagtgtggtggggaggaaataccaggagacccctttccacagggtcttaccttgactcttagcactgatgaccctcatgaggtcgagctgaggcagccacatcagatggctgtggagaggctgtcctggtggtcctaatgatttctagtggttctggaataaaccaccctggatgaatgcctttgaagttgatcaaaacagcaacggcaactggtctccatgtgctataggatccatacaacacagatcccactttctttaatgaattgctttgacccctttgtcaaattgcaaatttgtggatttcccattctgttccattgatctatttgtccacctttctgccaatcctacattctcctgattactatcaccttgtagaaaagcaggtattatagacagtaaggcagtatttacttttttttttctttttctctttttttcttttgaaacaggctctcactctgtcgcccaggctggaacacagtggcacaatcatggctcaatcatggctcactgaagccttcacctcccaggcttaattgatcctcccacttcagcctcccaagtagctgggactacaggcacatgcctccacgcctggctaatttttgtagttttagtagaaacaggattttgccatgttgtccaagctggtctcaaactcccgggctcaagcgatccacccacctcagcctcacaaagtgttgggattacaggcgggccccacaacgcctggcctgtattttcttaaaatacatgttttccttcaaaatcatgtcctttgcagcaacatggatgtggctggaggccattatcctaagtgaattaacgcagaaacagaaaaccaaataccgcatgttctcacttataagtgggagctaaacattggttatgcatggacataaagatgggaacaacaggcagaggagggaaaggggcaagaacaaaacagaggagggaagggagcaagcactgaaaaaactaccaattgggtaccatgttcactatctgggtgacaggtttgattgaggctcaaacctcagcatcatgcaatatatccatgtaacaaacctgcacaggtacccactgactctaaaaataaaaaacattttaaaggaaaaaaaaaatatatatatatatatatcccaaagtgctgcgattataggtgtgagcaactgtgcctggccttttttttttttttaagtaaagaaatatttccctgtatccggaatctttcaaaggtgagaatatgagagaaagaataaaaagaacatatatatataaattcccaacatgaggttgggagttcgagatcagcctgaccaacatggagaaacgccatctctactaaacatagaaaaattagcctggcatgatggcacatgcctgtaatcccagctactcgggaggctgaggcaagagaatcgcttgaacccgggaggcagaggttgcaatgagccaagatggcgccatagcactccagcctgggcaacaagagcaaaactccatctcaaaaacaaaacaaaacaaaacaaaaaccagcagttcaagcacaacaaccaacggcgcggacagagggcctcagtgtcagagagaccctgggaaggggtgaggaccacggcagcctggattggagagcagggtatccatgcgaaggcacagccctccttccactccagcccgggtcctggggaaagaagcgggccctgtgacaagaacacacaatggggaaaggacagtctcttcaataaacagtgctgggaaaactcgacatccacgtccagaagaatgaagccggacctttatctcacaacatatacaaaaatcaactcacaatagagaagatgtaaatgtaagacctgaaacttaaatctctcagaagaaaacctaatggaaaagctccacaacattggtcttggcgatgatgtcttggagaggacgccaaaagcacaggcaacaaaagcaaaactagacaaatgggactcacaaaaccaaagagcttctgcacagcaaaggaaacaaccaagagaatgaagcgacaacctacagagtgagagaaaatatttgcaaaccataaatctgacaaagagctgatatccaaaatacataaggaactcaaacaaatcagtaacaagaaaacaaataatctaattaaaaactgggcaaggaatctgaccagatatttctcaaaagaggagctataaatgggcaacagatctatttttaaatgctcaacatctctgatcaccagaaaaatgcaaattaaaaccaaaagagggtcaggcacagtattcacacttgtaattccagcactttgggaggccacattgggtggatcatctgaagtcaggagtttgagaccagcctaggcaacatggtgaaatcttgtctctactaaaaatacaaaaattaaccaggtgtggtggagtgcacctgtaatcccagctacttgggaggctgaggtgggagaatcgtctgaacctgggaggcggaggttgcagtgagccaagatcgtgccactgcattccagcccgagcaacagagtgagactccatctcagaaaaaaaaaaaaaaattaaaagtggtatatgactgtatatcctgcacatattaaaaagttaataaaccatgaataagataaaaggatataataataaaaggatatttaaacaatgttatgccaatgaatttacaatttgagatggaataaacaaattcctagaaaaaaattatacaggccaggcactgtgagaggccgaggcaggtggatcacctgaagtcaggagttcaagaccagcctggccaacatggtgaaaccccatctctactaaaaatacaaaaattagcctggcgtggtggcacacacctgtagccccagccacttgggagactgagacaggagaatcgcttgaacccaggaggtggaagtttcagtgagccgagatcacatcactgcactccaggctgaacaacagaacaagactccatctcaaaaaaaaaaaaaagaaaaaagaaaaagaaagaaaagaaaaaaaatacaatatgctaaaatcagcacaaaataaatagaaaacctgaatcattccacagctattatatttaaataaatcaaatcccttgtttaaaacttccgccagaataaaactccagacccatacagcttcaatggaaatatttaccaaacacgtaaagaagaaataatgtctattttatagataattttccagagcatagaaaaagaagatgaaatcccaaatccatttcacgagattaacataatcttgatgccaaaacctgacaagggcaaagcaagaaagtattgtaggcaaatatcactcattaacataaatgcaaaaacctgaaacaaaagatcagcatacggaatctggtgatacataaacaggataaaacattatcaccaagttgggtttatgccaaacacccaaaatggtttttaacattaaaaaatcaataaggaggctggacgcggtggcttacaccggtaatcccagcattttgggaggccaaggcgggcggatcaggaggtgaggagatcgagaccatcctggctaacacggtgaaaccctgtctctactaaaaatacaaaaaattagccaggcgtggtggcgggcgcctgtagtcccagctactcggaggctgaggcaggagaatgacgtgaacccgggggggcggagcttgcagtgagccgagatcgcgccactgcactccagcctgggcgacagagcaagactccgtctcaaaaaaaaaaaggaaaatcaataaggaggccaggcacggtggtttacacctgcaatcccagcactttgggagtccgagtcaggcagatcacgaggccaagagatcgagacaatcctggccaacatggtgaaaccccgtctctactaaaaattcaaaaaattagctgggcgtggtggcgggcgcctgtagtcccagctgctcgggaggctgaggcaggagaatcgcttaaacccaggaggcggaggttgcagtgagccaagatcacaccactgcactccagcctggagacagagcaagactgactcaaaaaaaaaaaggaaaaaagaaaatcaataagggtaatatgccatattaacagagtcaaggagaaaaatcttgtgatcatcttaggtgcagagagaagtagtgataggaatcaacgctcattcatgattttttaaaaactcttagcaaactaagagaactgcctttatctgataaagattgtctatcaaaaacctcagcaagcaccacacttagtgcgagacattcatatgtactttataataatttgttaacatggatgttgaagttttatgcacttttttgtacattttattttccacaattaaaaagacttttaggacaccataaaccaagagccaaattattcttttttttttgagatggagtcttgcttggtcgcctgtcacccaggccggagtgcactggtacgaacatgggtcactgcagcctcaagtcctgggctcaagtgatccttttgctgtaacctcttatgtagctgggacgacaggaccacaggcatgcaccaccataccaggctagtatttttttttttggagagacaaggtctcactttgttgcccaagctggtctcaaactcctggactcaaccgatctgcctgccttagcctcacaaagtgctgggattacaggcttgagccatcatgcatcaccagccaaattattcttaacagtgaaatactataggcattcctattgacatcataaacaaaacatgaattcccaatatatataataacatgattctggaagttcttttttgtttgtttgtttttttgagatggagtcaggctctgtcgcccaggctggagtgcagtggctcaatctcggctcactgcaagttccgcctcccgggttcacgccattctcctgcctcagcctcctgagtagctgggactacaggcgcccaccaccacgcccagctaattttttgtacttttggtagagatggggtttcaccgtagccaggatggtctcgatctcctgaccttgtgatccgcctgccttggcctcccaaagtgctgggattacaggcgtgagccactgtgcccagcctggaaattctaatcaatataggaagataaggaaaaacataaaatgtataattatcaaaagggaaaaaagttagagaaaattttttaattttaaatgaaaaagtattttaattcataattgaatttaatagagtggctaaataataaacatgtaaaaatcaatggctttcctataaactgctaataaatagttggaaagtaaagtagaaaagtgctcatttacattagcaataaaagtgtattaaattcctaggaataactttaacagaaacaataaagacttatggaaaaaaagcacagtgaggctgggcgcggtggctcacgcctgtaatcccaacactttgggaggccaaggcgggtggatcacttgaggtcaggagttcgagaccagcctaaccaacatggtaaaaccccatctctactaaaaatacgaaaaaaaaaaaaaaatagccaggcatgctggcacacctgtaatcccagctacttgggaggctgaggcagaagaatcacttgaatctgggaggcagaggttgcagtgagccaagatcgcgccactgcactccagcctgagtgacagagcgagactctgtctcaaaaaaaaaaacaaaaaatctgttcttgccaggcacggtggctcatgcttttaatcccagcaactcagacggccaaggcaggaggatcacttgagcccaggagttgaggctgcagtgagctatgatcatgccaccacactccagcctaggcaacagactgagaccccaactcaaaaaaaataaaaaaccttcctttctcacagaaaacaaacttccggatgggtattttttttcttgggtgttttaaaacgataaattatttagaagagggaaacagggtaagcacacttgctgcttgtgggtggaagttctgcaggagaggctggcaagagctgatgcatgcaggttcacagtggtatccgggctccatgttggcgcccatagctgtgcctgctggcttttctgcccacttcagacagaggtcccaaaccactcccactcccaacacgactctcacatctgctcactaccaaattctctcatttccaggtgtcagaaaaaaagcagccatacctgtcctggtctcactgtgccaatgcatttcataacatctcacccaaagtctgccttctccacttacatgctgaaactcggggccaagtgtccatgagccactccctgctcttcctgtaccagcctagcagtcctggacaagtcactttcttccccaagaccttttctccaatctgtcccaccaggatcttctgaagcatgaggcaaagccgtgctgacctccctcttcctcagacgtgcccagtccaagctcattcctacacaagagccctcgtatctactgttccctgtgcctggaaagctggtcccgatcctgtgtctgatccttttcctaggtctcggctcggacaggcatctgggaccctcttcaggggggttgtttcagcccacctgacttacagcatccccctacctgggtcccactgtaacatatcatcttgttctgttttcctcacagtacttatcacttctcacttcttgaaattatttttttgttttctttctttttttttcttttttcttttttcttttttttttttttttgaaacagagtctcgctctgtcacccatgctggaaggcagtagtgtgattacaggtcactgcagcctccaactcctgggctcaagtgatcctcatgcctcagcctccagcctcccaagtagctgggaccataggcacatgccaccatacctggctaatttttgtactttttgtagagacagggtttccacatgttacccaagctggtctcgaatccctgagctcaagcaatcagcctcccaaagtgctgggattacaggaatgagcctctttccctggcctcccttcatttttaataaaaattgtatgcaccaacttaaggtgtctcctgccctctggctctgcccacatctcagtccctcctttcctctacgtccctgccagtcttatctcctcttgacctttccgtccctcagcaacttctactatttccttctgccccaaatgcctagaaccaccactccctctctgcccagcaaactccctcttccctcctttcaaagtcctccagcctcacctcttccctgacgcctgcccttgctcagaacacctccacgcaggtgacagatcacccagtccaggatcaggcagtcgcctgctctcctgagcagcccatgttcctcctctgcttttccctggccggcggggcctacagtctgtccatttcacatgatcagcccctgggggtcaggaattctgccttgcactggcttcattatgaaggtcatgccctgtattcctgccttggcaacggaaatgctaggtgaatggtgggtatgtggatgaaacgcacaaggctcatgccattaaggacaccttctggccgggtcccttcttccctctctcagccacctcctcctgcttgctaagcttccccaagaagacagacccaggcccgctcacctgagagccagaagaggagcaggtagagtgtcagcaggggcatcttctcttcagacaggtccccgttcccctcagtggagcctggcagcaggaacaaactacagactcccagccttctgctggtactcactctcgcccttgaacttcctccttcagtcacttcccatgggtgaaagagactaaaagaggaaggaggtggttggttgggcaccgtggctcaggcctgtaatcctggcactttgggaggccaaggcgggcggatcacgagatcaggagttcaagatcagcctggccaacatagtgaaaccccgtctctactagaaatacaaaaattagccaggcgtggtggcgcacacctgtagtcccagctactcaggaggctgagacagaagaatcgcttgaacctagtaggcggaggttgtagtgagccgagatcgtgccacttgcactccagcctgggtgacagaacaagactctgtctcaaacaaaaacaaaaaaaaaaaaaaaaagaggaaggaggtggaaagggtgaaatttcgaggcagttgacaatgcaaggggtcacaggaatcatcagcttctgagaagtacctctctgtacacagccaccgtgggttctctaaaaagagaacttcgtggctcctctgtcatgtggaaacctgcagacagatccactgggtctggccagcccttatccaatcctccaaacctggtgggttggctgggggcaggggcacgcggctccaccagaggggtcctggagagccacggctgatagacacgatgtcctaaacctggagcttcaggtgtagccagatgcttgggagcccagaaggccagaagttcaagaggattgaggggcacttgtggccaaagtcagaaagccagaggagagattccagaccaaaggttggaaggcagctatgaggagattgggtatccaaccccagactacaaggccaggtacggtggctcacacctgtaatctcagcactttaggaggctgaggcaggaagatcacttgaggccaggagttcaagaccagcctgggcaacatggcaaggcttcatctccacaaaaaaaaaaaaaaaaaaaaaaaaaaaaagtcaggcatggtggctcatgcctgtaatcccaacactttgggaggccaaggtaggcagatcactccaggtcaggagttagagaccggcctggccaaaatggtgaaaccccatctctactaaaaaatacaaaaattagctgggcgtggtagcattcacctgtaatcccagtgactcgggaggccgaggtaggagaatcacttgaacccaggcggcagaggttgcagtgaacccagatcgcaccactgaactccaacctaggcaacagagcaagactctgtctcaaaaataataacaataataataataattagttctgcagagtcatgcatgcctgtagtccaagcaatctgggaagctaaggcctgaggattacctgagcccaagaggtcgaaactgcagtgagctatgattgagccactgttcactgtactccagcctgggcaacagagcagacgctgtctctttaaacacacacacacacacacacacacacacacacacacacgcacgcacagagaggttcagagagaagggagatgcaagcagggaactactggcccactgacaagaggcgctttgtcctgagaacacgaaggaagctcctactgctgtaccccagcccaccaggtgagatcccagggatacctacatctggaatcttccagaaacctgtccattgtaccagggggtctacctgaggaaaccagttcattgctcaggactattatcccctcgctccacccctcaccttataactatttgttgaaggaaggaaggaagaaaggaaggaccagttttgcccctcactctcctccttctgacaatcatgtccatcccccatctctcctttcccatcaagaccccagcaagtccctagggtcgggactggggatataaaaggattaggaagggccagactcagtggctcacacttgtaatcccagcattttgggaggccaaggcaggtggatcacctgaggtcaggagttcgagatcagcctggccaacatggcaaaaccccgtctctactaaaaatacaaaacttagccgggtgtggtggtgggtgcttataatcccagctactcaggaggctgaagcaggagaataacttgaacacaggaggtggagattgcagtgagctgagatcgcaccattgcactacagcctgggcaacaagagtgaaactccatctcaaaataaataaataaataaaaataaataaaaggattagacctttctcaccttctgcacctggagccacttttgccatgtgtcacatacaccctgtgacatcttgacaagggagtgagtctcaaagagggacgcaaccccctcacaccctaatcaggaatgagtgggtgtgcagagggttatttgcacagaaaaccacagcagctgataagccatggcttttccaggacgtggccagagatggcttctcgctttacatatctgcagaccataaagtaggtcaagaatccggggtgagggcttggccagccctttggtccctgctgcatgtcaataggtcctctgcccagggcaccatgcagatactcagagagcaatcagccctctgcagtagggaagccattggcttccaggaaaaaggaccaggaatgggggctgccctgaaaaacaaggggcagatgcatcgagggtggtggggtaagctttcttctcctgggcatgagcaacaaggagggaacagcactgtctgttagaactgcctgtggccagaccctctgatcgtggcctctcccagacctggcctccccaagaaggattcccctttgaaacaagaacagagaattcaggccgggcacggtggcttacacctgtgatctcaactctttgggaggctgaggcaggcggatcacctgaggtcaggagttcaggaccagcctggccaacatgtcgaaaccccatctctactaaaaaatacaaaaaattagccgggcatggtggtggatgtctgtaattctagctactaaggaggctgaggcaagagaattgcttgaacccgggaggcagaggttgcagtaagccgaggtcacaacactgcactcctccagcctgggtaactgagcaacacactgtctcaaaaagaaaaagcagagaattcgccaagtggttctgagtagctgctcctctaaccaagtgcctatggggaatacaggggaatcggctcttctgcaggccttgcgtcctcaaaaactcatttgaacctgtaatcctggtttgaccattgacctatacacaagccagttatatccctgggcttccctgtccccatatgtgaaagcagggattagacaggtcatctgagattctccctgctctaacgcacctatgtatgtatgtatgtgtgtgtgtgcatgtatgtacgtgaatggttgaacctgtcattctgccctggccttgtgtgctctgctaggggactctgtctagcacctaagaaccagtctctgtttttataaatcataattcttctcagaaaccattcctgagcccttttagttcccctcacttccaattgcactttatctttcccaaccacttgtgctatgtttcatattttccatcattattacattgaatcctcactataaatctagaggaaaggtgatgcgtttctcatttttcaaagaaattgagacgcagagagcaagtgacgtgtccaaggtcacatagctagtaagtggcagagccaagattcaaacccaggcctggttcatataagccatgctgccttgtgtcagggtcagggagggggcagagaaagagagagagagagagagagagaaaacagcccttagatcctgctcagtgctgacaatgaagaattgataaagcagagaatcccggagctggttgtcaccagggcgtccactccaaggttgttttttaaacaaatttcctggccgggtgcagtggctcacgcctgtaatcccagccctttgggagggcaaggtaggcggatcacctgaggtcaggagttcaagaccagcctgaccaacatggtgaaaccctgtctctactaaaaatacaaaaaattagcttggcatggtgataggtacctgtagtcccagctgctcaggaggctgaggcaggagaatcacttgaacctgggaggcagaggttgcagtgagctgagatcgcaccattgcattccagcctgggcaacgagagcgaaactctgtctcaaaaataaaataaaatgaaataaaacaaatttcagaatgaaagaatgttttatcatgcactgaaaactgacttattaagcaggtaactgataccaccagccttgaacattttccagatctcatgcccctcttctgcagtgtatggaatgggaatctgggccttacccaagttcttgtccaggaattcaggcacaggcaaagcttatttctgagaaaaataggcgtctccaaagagtgagtctgaaagtttgtgtctctcgaatttcatacgttgaaacttaaccttcaatgtgatggcattacgaggttgagcctttggagagtaactaggtcaggagagtaactaggtctcctgaatgggattagtgcccttataagaaaggccccagagggctgggcgcggtggctcatgcctgtaaccccagcacttagggaggccgaggcaggcagatcacctgaggtcgggagggagttcaagaccagcctaaccaacatagagaaaccccgtctctactgaaaatacgaaattagccagatgtggtgcatgcctgtaatcccagctactcaggaggctgaggcagaagaattgcttgaacctgggaggcagaggttgtggtgagccaagatcgtaccattgcactccagcctgggcagcaagagcgaaactccatctaaaaaaaaaaaaaaaaaaacagaaaagaaaaagaaaggtgccagagagctgccttgccccttctaccatgtgaggacacagcaagaaggagtcctccctgaggagtgggtcctcaccagatcctgagcctaccagtgccttgaccttggactctccaggctccaaaactgtgagaaatacatttctgtttataaaccacacaatcagcagggcatagtggcccacacctgtaatcccagcactttgggaggccaaggcaggcagatcccttgagatcaggagctccagaccagcctggccaacatggtgaaactccgtctctaccaaaagatacaattagctgggcatggtggcacgaccctgtagtcccagctacttcggaggctgaggcaggggaatcacctgagcccaggagacggaggttgcagtgagccaagatcgtgccattgcactccagcctaggtgacagagtgagacactgtctctaaaacatcatatcatatcatacatcatatcatatcatatcatatcatatcatatcatatcatatcatatccacccagtctatggtattttgttatagcagccgggactaagatagtgggttagagaaaaaaaaagggctctttgattttcagaatagagcacctgtcatctttgctacctgctccttgacaaagtggaagagctgcaattgaggctccccctgcctagaaaatttgatcttgtttttaagcacctattaattggctagatgtatttggaaaaaaaaacaagcgtttgttcagcaacaggtaggctaaacttgggcatccccttagctttcatcagattccccagtgcaatgcacctcctcaacacacacacagactttttcccactacaaaagtaatgtgtgtttgttagagaaaaacagtgaaatacagatgaacacaaagaatgcatcttaagtcactccgaatcctgccacacagaaataactgctgttaaatatatgtgtgtgtatctattaccaatcttttgttcttctgtagaaaagcaatttatttcaggttacatgaaggatcactcatgtatgagtttgctttaccaactggactactacctttattagggcattttaatacaggaaaaacataaaaagtatggcagtggagggtgttgataatggggaaggttatacatctgtgggggaaaagggtctgtggaaaaatccctgtatcttctgcccagtgttaatgtgaacctagaaattctctaaaaattaaatcctattttataaaaaagagagacatggccgaaaataccagctctgaaatacctccagttaatactttctttaaaaaggtaaaatgcaggccaagtttggtggctcacacctttaatctcagcactttgggaggccaagatgggtggattacttgagcccaggagatcgagaccagcctgggaaacatggtgaaaccccaactctgcaaaaaatacaaaaaaattagctgggcacagtggcatgtgcctgtagtcccagttacttgggaggctgaagtgggaggatcacccgagcccagagaggtcgaggctgcagtgactcgtcatcatgagccacagcactccagactgggcaacacagcaagaactcatctcaaaaaaataaataaataaaataaaataatttgctcacaattacctttctttttcttttccttttttttcttttgagatgggttctcactgtgtcaccaaggctagagtacagtggtgcaattatagctcaatgcagctgtaattctggaaaatctcctggactcaagtaatcctcctgcctcagcctccccaatagctgggaatacaggcatgcaccaccaagcccagcttattgttttatttattgtagaatagggtcttcctatgttttcaagctggtctcgaactcctgggctcaagtgatcctcctgcctttggcctccccaagcactggaattacaagtgtgagccactgtacctggccaagcaaattatttaaataaattttttaaaacatagaaaaagattaaatgaaaagtaaaagtcttatctccatttcccacctaccagccccagaacctcaaaggcaatcctcttggcctctattgcctccctgagaaaagttaatcatactccagcagataaacctaagtaacatatacacattcatcatactatatacatcactctgccccctgcttcttttgcttaataatgaactttctcccaaacagtgagacaggagagttcctttgacccttttgcaggtaggaactggagggcaccagctctgggtccagtcggccatttaggcaccagcagggacgaactttacttgctcgaacccactgggttcagcccctcgtgagagggagcacacaggcaagtgggtgctagggctgggacgagtacttttgggctctggccccacggcagcatgaaggggtgtgttacaattaaggttcttttaggccaggcatggtggctcacgactgtaatgccagcactttgggaggccgaggtgggtggatcacctgaggccaggagttcaagaccaacgtggccaacatggcgaaaccccatctctactgaaaaaaaaaacccaaaatttggcagggtgtggtggcgggtgcctataatcccagctacttgggaggctgaggcaggagaattgcttgaacccaggaggtggaggttgcagtgagccaagatcccaccattacactccagcctgtgtgacagactgagcctctgtctcaaaaaaataaaagaaaagaaaaacacaattaatgctcttttagcagttgccatccacagatggctaagtgttagccagctcagcggagagtcaaggtgacagcctttttacaccctgccctcttggtacagagttaagtgttaaccagctcagtggagagccagggtgacagccttttacaccctgctctcttggtacccgggttcttgtcaggtgtccaggaagaatcaggtcacatagacttgaaggatgatgaatgcggagattttattaagcggtggaagtggctctcagtggaaggggagctggaaaagggatggtgtgggaagaaggtgatctttccctgaagcctggctggagataaccgggctcctctctgaagccgtgccatctgaagttaagccgtgtctatccgtatgctccgatgctcagttgcttccactcttgacgttcagctgcttgtctcttctctccttctcagctacaccactctgctcgtctgccaagagctttttatgggtacagggctggggacatggtgggccagggtggttttggaaaaggcaacattcaggcaggaaaacaggaatgcatgttctcatttagggccgcaggtccaggcttgagggtggagccatcgccaggacctcgccctcttttacccagtatttccctgctgcaacagggacatacagtacatacagatcttcctcatccttttactgttttcacagtactgcattgtatgtatattctagagtttacttcactagtctctactgctgaattatttgttcttacaaacactacaatgagcatccttatacacatatcttggtttactttttttttttttttttgagatggagtcttgttctgtcacccaggctgtagtgtaatggtgtgatcttggctgactgtaacctccacctcccaggttcaagtgattctcctgcctcagcttcccgagtagctggcattacaggtgcacgtcaccatgccctgctaatttttgtattttcagtagagacagggtttccctatgttggtcaggctggtctcaaactcccaacctcaggtgatccgcctcggcctcccaaagtgctgggattacaggcatgagccaccacgcctggtcctcttggtttatttttgcaaggaaagccatagagttgctgagtcaaaggaatttgcacttgaaaccttgatagatattgtcagttgctatccaaaatggttgctcaatgtatactcccactaatagtgtatgtatgagtgcctgtttccccaaatctaagccagtactgaccattaccaaacttttatcaagccgctatacattatattgtcattgtatcggttagggttctccagagaaacagaaacggtaagctatatatatggaaagaaagagagatttgtcagccaggcacagtggctcacgcctgtaatcccagcactttgggaggctgaggacggtggatcacgaggtcaggagatcgagaccacagtgaaaccccatctctaccaaaaatacaaaaaattagccgggcgtggtggcgggcgcctgtagtcccagatacttgggaggctgaggcaggagaatggcgtgaacccgggaggcagagcttgcagtgagtcaagatcgtgcccctgcaccctggcctgggcgacagagcgagactctgtctcaaaaaaaaaaaaaaaaagaaagagagagagatttgtccgagaaattggcttacatgactgggggctggcaagtccaaactctgtagggccagcccaaaggctgtaaattttcaggcgagagttgatgctacaaacacgaggcagaatttctgcttcctcagggaaacctcagttttgctcttaaactctttcaattaatcagaggacactcacccagattactgaagacttaaagtcagctgcttggagatgttaacaacatcaacaaagtaccttcacagcaacatctagattagtgtttaattgaataagtaggactatagtccagccaagttgacacataaaactaaccacatgtacacaaaaatatatcaacctattcacatcctttgttcacttttctattgaagttttcttctgagagctctccttatatgagggatattaccatatgtcatatgtctcgaaaatatcttccctgtaccatttctcattcgactttgtttgtggaatcttctgtcaaccaaaacatttttattgcagcaaatctatcgatcttttctttatggcatctgaatttcctgtcttgttaagaaggtcactcagagccactttaggagccatggtaaccatcccatttatcaggttttctaaaagctgtccctgaataataaagtcacagaaaagcagcaatagtgtacttagacagcattagcctggctcccattgagaggcctggataaagtaggatttaatgttatgccctgcatttatcaagggtcgatacaacagctttagaaaaagctttgcgtcttccgcaaagttgcaattgcccattttgttattcaaggccccttgcagaaggatccacttaacagattatagcagtgtataacaggagaaaatactcgatggaaaggactcaggcatacaatgtcagacaagtaccatacaccccacctggttttcccctttgccttgattgtcaggaaacctataaccaaacacaatgctcaaacgcagtaacaacctaacctcactctgggatggaagatttgccccagcccaccccacccctacacacacacccctattctttgtatattttttcaggcaatttcttgaactgccttctcgtacttgtgggtttgtttgaaaccacctgtccccattggaagtgaatgaggcacaaatacagatataaacaaaatgactcaagaaagaacaaagacgcttgtctgaatggtggcaaagttgacccagaggtttctgtctgaaccacaattaactaactttttttttttttttttttttgagacggagtctcactctgtcgcccaggctggagtgcagtggcgtggtctcggctcaccacaacctctgcctcctggattcaagtgattctcgtgcctcagcctcctgagtagctgggactacaggcgcgcatttttgcctggctaatttttgtatttttagtagagacggggtttcactatgttggcaggctggtctcaaactcctgacctcgtgatccacttgccttggcctctcaaaatgctgggattacaggcatgagccaccgcacccggccgtaacattttcataaatgcgaagagaaacacaaagagggaaggcatggtgacaaatctggacccaaagttgacattcagcttctccaagcagtgaaactgggaaccaacttggagaaatttaaggaattttcagcagctgttgggtggcgagagaagctctgctgggttatctgtgaaaccagaaaatctgagacaagtctcagttaatttagaaagtttattttgccaaggttcaggacgtgcccatgacacagcctcaggaagtcctgacgacatgtggccaaggtggtcagggcacagctaggctttacacattttagggagacatgagacatcaatcaagatatgttaagaagtgcattggtttggtctggaaaggcgggacaactcagaagcaaaggcagaagactggaaacatggagggagcttccagatcacagatagttgcattcttttgagtttccaatgagcctttccaaaggaggcaatcagatatgcatctatctcagtgagcagatgggtgacttagatgaatagatgggaggtaggtttgccctaagcagtttgcagcttgagctttccttagtgattttgggggcctaagatattttcctttcacatatctgtctcatgtgtccgtgtgaagagaccaccaaacaggctttgtgtgagcaacgtggctgtttatttcacctgggtgcaggcaggctgaatccgaaaagagagtcagcaaagagcagtgggattatcattggttcttacaggtttggggataggcagtggagttaggagcaatgttttgcgggcagggatggatctcacaaagtacattctcaagggtggggagaatagaaaagaaccttcttaagggtaggggagatgacaaagtacattgaccagttagggtggggcagaaacaaatcacaatggtggaatgtgatcagttaaggctattttcacatcttttgtggctcttcagttgcttcaggccatctggatgtatacgtgcaggtcacaggggatatgatggcttagcttgggctcaaaggcctgacaatatctaaggtaatggatttaggcagctccatccctaacatttgggggccagggctagaatacaaatggaggcccacataccatgtgtctcagtatcttaacattctaaagcaagctcaaaaagctacaaaatcaagtgtgtctaatcttccctcctgaacaaaataccttcttaccaacctggaagccaggttagcatgtaggattctcagaagttccacactaaaatgtggcagcctagggacaaacaacctcctgtccccagccccccacccacaagctcctctccttctcctcccacccttgggcaccccaaccccaaaggaattttcagcagctgttgagtggcgagagaagacatgtaacaagtgcttttggtttggtcagaagaatgcatgaggctccacatccaagctctgtccacagcccctgcaaatcgtcaccccttggccacaccacagacctagggatgccaccataagagcaaccttggggaaaagtgcagtcagtctacaggaggaataggagcctttggccatgtggacacctcgcttcatggggaggagcacagagaaggagcaggcctaagggaggtcctaggtttaggaagagatcattcaacaatgcttgtaaatagaccagcgctgagctctccacgatggcctaggtaaaaagctcttagagtcattatcagtagatttttttttttttgagacggagttttgctctgtcacccaggctagagtgcagtggcatgatcttggctcaccgcaacctccaccacccgggttcaagggattctcctgcctcagcctcccaagtagctgggattacaggtgcctgccatcacgcctggctaatttttgtatttttagtagagacagcatgttggccaggctgacttcaaactcctgacttcaggtgatctgcccatcttggcctcccaaagtgctgggattacaggcttgagccaccgcacctggccattgtcaatagatttctaatgctgataaaaaaaagacctagcagggcattgtggcttacacctgtaatcccagcactttgggaggccgaggcaggtggatcacgaggtcaggagatcgagaccatcctggctaacacagtgaaaccctgtctctactaaaaatacaaaaattagccaggtgtggtggcgggcgcctgtagtcccagctacttgggaggctgaggcagaagaatagcttgaactcgggaggcaaaggttattgtgagccgagattgtgacaccgcattccagcctgggcgacagagagagactctgcctaaaaaaaaaaaaaaaaaagaccatgaccaatatgagaggatcatcctgccccaccccgagccaaggttcagctgaatctgaaatgctgaaccctatgtgcacccccggacctcagtgagctggaaaatgtcccgagaagacaggactgtttcctatgatgaaaattgatggaaactcctcaccctggaaaggaaaaggataaaagtgaaaagaattagaatctgtcacattctttaagacacgaatgaggggaacgtggatggactacccctcacattctggaatattctctctaggaagcacttcttaaagcctgaggaagttagattctagatgtaaattattaaaaccactgcacataacaaacaaatgagttctctaaccaggaggaaataaaagctggagaggttcaggaggtgggtgggggcacagtcatgggacatccaaagtcaatgccatggacaacctcatggtaagcagacgctgatatgcattcccttccatgtcactgccagagttgaacagtggctgggcccgacccaaagaggcccagccaatctctatgcttttacggtttagttgtttttatgtctttatgtttttacaagtccagctaaagtttgcacctcctagtcctttcacacagtcttgaattcttgtctttggaaagaggccactgtccactttacactaaggcatttatccactcacccattcattcatccattcattgagggtaccagcctctgggtgcatgtagagttcttctctgttgtttatgattttctttcaaacatttcatctgaacttccaagctaattatcgccccttctccctcccagttcagacctcccagaggaaggcggccttccccctcttttcccagaatctgcttctctttgaaatcttgtcttctccttgttctaagtccaagtgtgcaaggcacataccagctatctgattttgttttattctatagactggatttttggggctctcccacacaggagatctatggacattgtgttagtcccggtcttccgaagaggagatgtgaagagggaatcaaatgtgcaagggttttactgagggaaatgcctgtgagagaaatagagtaggtgccagggaggccaggggagccttcagaccatgatgcaggttggatccccgtgaaggaaagagggcagaaaggttgcatggaagcatcccagaccaccttgcagtatctggagggttgtgcaaggccatgagggagcccttgagctaactcaaccgttagaggggtcctgtgtctcccaggaacaggcctgcctcagtgtccctgctgtgctccgcctttggctggtaattgcctgtaggaagcatgaccttggtgcaaacatgacaatgatggctttcagagcacggcagtggggaccatcggtcatggatgcccctgtggatggaagtctgagagacacattctcatggtcacttcagatgctcattaacttggagggagatctcctctgtgccttcatgcccctttcagtgacttcaatagaaaatcgagactttagtgtgtttgtgtgtctgggtgtatgtgtgggtatctgtgtgcatgtgtatgtgtttttatgtgtgtgtgtctgtgtctgtgtttgtgtttatgtttgtgtgtatatctgtgcatgtgtgcatgtttgcgtgtatgctgcatgtctgtgaatgtgtgtgtctgtgtgtcggtgcctgtgtatatgtgtctgtgtgtctgtgtgaatgtgcatatgtatgtgtatatatatatgtgtttgtgttatacatgtctctgtgtatgcatgtctgtatatgcatgtctatgtgtttctgagtttctgtgtgtgtgcatgtgtgtctgtgtgcatgtctttgtatatgtttctgtgtgcatgtgtttgtgtgcacatgtgtctatgtctgtgtatatgcatgtctgtgcgaatgtgtgtttctgtgtgtttgcatgtgtgcttgtgtctgtatatgaggatacatgttggtgtacatgtgtttccacatgtctgtgtgcatgtgtgtgttctgtgtgtatgtgtgtgtttgtgtgtacatgtgtgttttatgtgtactatgtgtatttgtgtttgtgtgtgtagatgtttttgtgtgtatgtgtatctgtgtgcatgtgtgtgttctttctatgtgtgcatgtatgttttgtgtgtttgtgttgtacaagtgtgtctgtgtctgtatacgtgtgtttctgtgtgtacacgtttttgtgtctgtgtgtgcatgtgtgtttctctgtgtgtgcatgtgtttgtgtgtgtgcctatgtttctgcatcatgtgtgttctgtgcatatgtgttgtatgtgtgtatgtttatgtgtgtgtgcctctgtatgcatctgtttctgtatgtatatgtgtgctctgtgtatgcatatgtttgtgtgtgcatgtgtgttctgtgcatgtgtgtgcatgtgtgttctgtgcatatatgtgtacatgtgtttttctgtgtctgtatgtgtcttgtgcatgtatgtttctgtgtcatgtgtgttctgtgcatacatgtgtacatgtgtttttctgtgtctgtatgtgtcttgtgcatgtatgtttctgtgccatgtgtgttctgtgtgtatgtgtgtacatgtgtttttctgtgtctgtacgtgtcttgtgcatgtatgtttctgtgtcgtgtgtgttctgtgtgtatgtgttgtacatgtgtgtacgtgtatgtgtgtgcttctgtgtgtatgtttctgtgtgtatgtgtgttctgtgtgtgcatatatgtttgtgtgtgcatgggtgttctgtgtatgtgtgtacatgtttttctatgtctgtatgtgtgtgtcagtgtcttgtgtgtgtgtgtttctgtgtgtgtgtgtgcatgttgtgcacatgcgtgcttagaaagaatccactcccacagccacaaggacacctctgaggccaactcacatcacaggccctcagctctctctctattgttcccttccagaccatcctggtgggtgacagtggtgtgggaaagacgtctctgctggttcagttcgatcagggcaagttcatccccggctccttctcggccactgtgggcatcggattcacggtaagcactggccggcactgccagctctgggcctgggctcaggaccccagcgtgtttctgttgagtgccagcaggaaacaggtggacactcgcattggatcattcaaggaggattaaggagaagactgttccccaaggtgtaggagggtgttgggtgaccaggagggagggtatactgcccctgggtagtccaggaactccgcccacctctagcctcaagcaggaagggaaggcaccctcaccagaacccagggacaaagcaggctgctgggtgagctgcctggcaggagctgcgtgggactttcagtggagggacacagcagcccatgggagccccccagggaggcagccaggagaacaatcccctgtcccaccttgctctcctcctgctccccatctccttctggggctccacattggatgaacgcaagtggaagccagaaagcaaaaaatattttaatatgggatagctcaggtcagccctccaaggcaagaagatctggagggacaaagggacgacaaagttttcagcacagtccaaacttagcagtcacacgggtctcagggagctggcaggcccaggttacagttccgtgtttagtcctcggtaaaatggtaaaagggcagctcgggttaaggaagcccagtgccctcggctttttctgcccgcagcccctctgcgagacaagggatccctcctttaccacacatcccatctccccgcgttgtcccgtgcctgcggctgcagctgcccttgaattcctgggaagaccttgggagagggttccactcctctctcgggctgtggcaggaagagcagggccttcccttgggactccagaatcctagcatctcaagatggggaagagcaaacatctcttcttggacaacgcggatgtttgggaacctctgagaccagagcacagggcctgtgagatcacgctcagggtcaggacgcagcagtgccacactgatgggaagagagagaggaaaactcagaaaaatgggcttgcccactgggtcacagccaggaaggcaggggttcagaatgaacatggcttctgcatgaccttccaggaggcaaagcggaagtgagtgcctggttcgggtgtgttctggggcctagaatcggccctgaaacaccagttcccagggctctccccagactgggaccggctgggctctggtagtgctgaatagggaagggctgagacccaggaggccaaggctacctggcaatccctgaggtctgggaccaggctgccatgaagcaaaccaggatgacctggtgccaggcgtcacccaccccagcccaggcccagtctgctctcagcagccagggcacaccctgccctcagggtcacacccgcatctcctcacccacccttctgcctgtctggtgaggaaggaagagagtggggtggatgtggctgtggacatgcaaagtctgactcacgttccacagaccacagaggtgagatctccaaattttgccgctagcttggcaagaaaattgaggccgatttcctgtgaaggaaaaagaaagtgtgtggtcaaactgtttgtctagcctgagatgagacacactgggctttcccactgacctcagggtgggcctcctagagcctgggctgcctgcttggtaccagccagcacccgatgttctggtgcatctcaggacaaacctgttgcctgcttacgctgagtgaggacctgagcccctggccagaaactcagcctggggacacctgagcaaagaactggtggacatcggggtctcctccagatatcagcggtctgggggtccccggagagccaggctacaagacacttgtttacccatctgtccttctcacggagatttgagatatggcatggataagggccctgccgctggccaggctgtagcctgcaactcctgcatgatgggaagggaggcaggtgctgccacaggctccgctcaggaggctgagtgccgcccaggtggcaggggagggacagagcccctggtctcccactttggaggagccagaggtgagcagggtgactacctcgggcatgccttcacccataaactaccaggcccatcgccttctggaagtgggacctgcccaggtcctgtgtagatgcctctcagtcaagaccttccctaaattctccactaccagccccatcaaactggctgtgggggtcgtgctgatggggttatggcacactgatgtcgatggggttcacacaggggtctttccagtccaccacagttcaggtcctccttgttacctctctcctcagtttcccccaaattccctagtcttgcctaaacactgatgcaaaattcctctttcaaaaccttcactcaggccaggcgtggtggctcacacctgtaatcccagcactttgggaggccgaggcgggcggatcacttgaggccaggagttcaagaccagcctggccaacatggcaaaaccccttctctactaaaaatacaaaaacgtttgccaggcgtggtggcacacgcctgtaatcccagctacttgggaggctgaggcaagagaatcacttgaacctgggaggcggaggttgcggcgagccaatatcatgccattgcgctacagcctgggcaacagagtgagactccatctcaaaacaacaacaacaaaaaaaaaaaaacacctcactctgctcatcccccacctgaacattcacggttcactattaccttccaaataaagtctgaatctctcatctgttggtcaagctgttgcacagtttagaccagtggttttcgaacactccttcagcgcacataaaagcctccagggggaagctcatctgaaatgcaaattctaagctccctcatacacatgctgcttcagtaaaaccacgtggggggcccagaatctgggggttctgacccagggggtccatgcgccacattttgcaaaacatgagttgaggccttgtccctccagtctctgcccgggtctccttcccacatcccgaccctgtgctctttgggctgtgctgttccccagctctgaagttttctgccatcgacctggatagcagggagtcccctgcccccatctctgcaggtgtgatttgaggtgtgtgtggtgaggtgatttgaggggtgtggcaggtgtgtggtgtgatttgaggtgcgtggtgaggtgtgtggtgtgatttgaggggttaggtgtgtgtggtgtgagtgtgtgtgtatggtgaggtgtgtgtgtctggggtgtgatttgaagtgtgtgtggtgtgaggtgtatgtggtgtgatttgatgtgtgtgtatgtggcgtgagatgtgtatggtgtgatttgaggggtgtgtggtgtgacgtgtgtggtgtgatttgaggtgtgtgtgatgaggtgtgtggtgtgatttgaggggtgaggtgtgtgtggtgtgaggtgtgtgtggcgtgatttgaggtgtgtgtgtgtggtttcaggtgtacacaagagcccccccatctttcaacacgcatgagggtctgtctcactgacacttggtacctccactatcagcagggctgcatgacaatgacagtgtgatctgtgatcaggagggtaggggtgtctatttgggggtattgtgggggtgtgcgtctcagatctggaggcaataagaggtgttgggggtcatttatagggtgatatacacatttggtgatggtgtgaggcatggggtccattggagaggcaggtgtttgcacagtgatgtggcacaggtgttgatggtgtgaaataaactgtgcctggagctgcactgtggtgacaggagtgtgtgtttggagtgaaatgaggtatgtgtgtttgagggtcatgtaagatgtgtatgtatgtggtatgatggtaggtgtgtttgtttatagtatgaggtgcacatttgtggcataatacaaagttgtgtgtgggacatgttatgaagtgtgtgtttgtggtataatgtagggtgtgaggcatgtgtatttatggtatgatgtgaggcagatgtgtgtggtatgatgtagggtgtgtgtgtatatttgtggtgtgatttgagagtgtatgtgtgtgatgtgaggtgtgtgtgatttgagggatgtgtgtggtgtgaggtgtgtggtgtgatttgaggtgtgtgtggtgaggtgtgtggtgtgatttgaggggtgaggtgtgtatggtctgaggtgtgtgtgtgtggtgaggtgtgtgtgtctgtggtgtgttgtgggtgggtgcacacgtgtgagtgtctgtggtgtgtgtctggggagagacacaggctaccacagcgcatacacagcctcagagtgaacgttaggaggcccaggtttcctccccagagaccacacggatcccttagtgagtccctattctgcacagcccctgttccctgttctgaatgtcttagaccctaacccacttctgactcacccgaggctgcccttgaacaccctacaggacattacagtggccctggggacagtgtacgcaccctccaagtatgacattacccacataccacagacccagcaggcctgcagcccctctccccatgttcaaagacttcttccctaggtcagattcctccatccagactagtgcagcaacgcagcagggaagtgcttcaggccactgctccttctggatgattcgtgctaatgttcaaccttctgtattccaaacccaccataggacaaagagggccttggagccaacaacgtgaaccacagctggaggctagaaatctgaactcaaagtaccagcagggccacgctccctctgaaggctccagagaagggtcattccttcctcttccatggccttggtggctcccaggagtccttggcattccttggcttgcagccacactcctcccatcttgcctctgtcttcacctggatgtcttttccctgtgtctctttcttcttatgacaccggtcatactggattaatggcctgccctatattagtataacctcatcttaatgagtgatatctgcaatgaccacatttccaagtaagggcatgatctgaggtactggtggttcagacctcaacctgtctttgggggacagaattcaacccataacagcatggtttacagtagaaggtgagcatgaggcatgccctgtcccctctctcattcttcctccaccatttccctcctgcaatgaaaacccgcatcctggctgggcacagtggttcacacctgtaatcccaatactttgggaggctaaggcaggcggatcacctaaggtcaggagttcaagaccagcctggccaacatggtgaaaccctgtctctacaaaaatacaaaaattagccaggcatgatgatgggcacctgttatcccagctacttgggaggctgaggcaggaggagaatggcttgaacagcccgggaggcggaggttgcagtgagccaagatcgtgccacttactccagcctggatgacagagctccacctcaagaaagaaacaaaaagaaagaaagaaagagagacagagagaaagaaagggaaagagagagaggaaggaaggaaggaaggagagaaagaaagagaaagaaagaaagagagaaagaagaaagaaagaaaaagaaagaaagaaaaagaaaggaagaaagaaaaagaaaggaaggaaggaagaaagaaagaaagaaagaaagaaagaaagaaagaaagaaagagaaagaaagggaaaagaaggaaggaaaagagaggggaaggaaggaaggcaggcaggcaaagaaagaaagaagagagagagagagaaaggaaagaaggaaagaaggaaggaagggagggagggaggaaggaaggaagggagggaggaagggaggagaggggaggggagggaaggggagagaaaagaccgcataccaggccaggtgcggtggctcacgcttgtaatcccagcaatttggaaggccaaggcaggcgtatcgcctgaggtcagcagttccaaaccagcctgtccaacatggtgaagttctctactaagaatacaaaaattagccaggcgtggtggcgtgcacctgtagtcccagctgctccagaggctgaggcaggagaattgcttgaacctgggaggcagaggctgcaatgcgccaagatcccgccactgcactccagcctgggcgacagagtgagactccgtctccgggagcccacggcattgagcaaacctcggcattatttgcagcaagagcctctggcatccaaatagcaaccaacaccacgcctctgtagtgtgctgcgcagcctccacactccagtctgaggctccctgtttgagtcccgccctatgcccagctgaggttatagcacgctcacctccagaagaggtaacccaagctctttactctactggagatcacctctgtccccactctgggcgcttctcccagctgacagaaaatacctccagctgatgtcagaaaatacagggctggaggctggcgtacaaagtcagtccccacaggcctatggtggcccataagccacgtctacccctgctcctcacctccacacctaagttaagaattgcaggccgggcgcagtggctcacgcctgtaatcccagcactttgggaggctgaggtgggcggaccgcctgaggtcaggaatttgagaccagcttggccaacatggcaaaaccccgtctctactaaaaatacaaaaagaaaaaatagccgggcctgatgtcgcgcacctgtaatcccagctactccgggagactgaggcgggagtatagcttgaacccgggaagcaaaggttgcagtgaggcgagatcgcaccactgcactccaggctgggcgacagagtgagactctgtctgaaaaaaaaaaaaagtgcaggtacccctctccagctctcccctccctacacatccctcaaaccgtcccgctgtaatgcacccgccctgttccttggtaacttgaagctgcttatagaatgtggagatgggggtaattgaaaggtcggcccaggccacagagcccctgagctctgctaccggcaaccccagctgcactccccactctctgtcaccaggagctgccgggtgcctgggatatcctggcagctctgctcaaaatgatctacgacttcatgaatttatttggctcctcctcggggccagggtgagtgtcatgggttaataaggccggccccgccttcaggagcggtccactgggagatgtgtgctgcgcagccctcttgcgaaagctctcccctggtgggacattctgggcacaaccaacaggccgggggaaatgagaggtgatccatactaaagggtcaaagtccccgcaccaggcagaggccccaaaacaccgcagcgtacatgtgctgcaaggcgagtacgggttggtaaacaaaactatattcagatgagctcgggccgggtgacttaacagatgaggaagtgtctcggggccatcggcggaggcgcagcccaggggtccccagctccccgcctcgccacctggggacagcccacggcccggggctcgggcgccgcctgctgtcgcggtgcgcagcgactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaaggtccgagccggtgtcgtcgagggggcgacgggacggagggaggagcctgaggggtcccggtcgagggaggggaggagtgggcggggcgggggtggggccgttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgggtgggcctcttccgtgagacccccgccctcctcggcgctagccccttcctggctgcgtctgggttggactcagcccttcccccaggcagctgcgtctcccagaggagggagggagagagggtcaggacacagcctctggggccgtcccaagctctaggtgtctctgctggcttggtgggggcgggtcgcggaagatcgcaaaaactgagtgatccccccgccggccccaactcagttctcttctgccacactctggcaaatatgagcccccgggagcccatgcttcttggtgagggttaagcgcgcaactctcggggctcaggctgggaagggctgggagatggggaccgaacggagactcggagaggacgtcccctgctggcagaggaactggcgttaatgccattttccgagctaagctcttagttgagatctgacatccaggtttaaggcctgatgtcccccagctgctcccctcccattccacccgctggaggcactgcctcccaccttcctccctgcagtcggaagccgctcctcccagaaggatgttgccagccggcctgcaggtcacttgggaatttttcgaacctgagaaagatttcagtggttggtctttcgcatcccgcacttgagagagctccagggctgctctctggggcttgctccctctacaggggtgtcctgtatggaaacaggtagggacagcagtggactggtctgtcgccttccatctgtgtccttggagtgagcgggtaccagaaactgaaagaactgctgagggagcctagagcttccactcttcctctgcagggttggggatggagtgagggctgtcctggattccgctgcatggccttgaaggagacctgcctctctctgggcctcggtttcctccccgacaccagggctcacccttgctgggagcctcagcctccaccccagtgtttcgggggaagccaccctgcaagtcatccgcccagagccgttgagataggcgtcctgtgtgggcttgtggcaggaaatgggcccctgcaccctcggagaggaggagctgctgttggccaggccccaggctgagggggactgcctgaccttgttgccctgcaaaccagctgggttgtttgcctaggaggtggccaggctaggcagctgtttgtgtttggtggaatcaccgagctgggtgggtagctggcatcgtttgctcaaggcagctgtgatctgtaaagtacacaaagactggccctccctccctccttcctgctccagggctgggacccaggagccagggaggagtgcaggctccagaaagctcctatcccccaccccttcatctgttccctggccaagcggcattggccggagagttggtccccagcctccccgggcctgccccaggggagtgagtccaggaccctctgagaaagcctggcaggagctccttggaccagactaggggtgatgtggcccacaggcagacagttcccaccctgggccactcttccctgggtcttaggtgattcaccacgatgatgggccctagccattaacagactctagaaatacctcaaagacattatccctcctccttctacccactatggaaaccatgccacagaaaggttaaggaatcttcctaaagtcacacagtaggccatttacaaatcaagacccatccttcataccccttctgctcagccacccctgcctctccaccagagttaactaatgccagtaccccatgcccacaacaggaatgcctttgggctccactgtcaatttcagagcctcaaaaataattcaaacctagtccctgcttaacccattaagccacctaaccagcagctgggaaattccagcattggatctagacccctgttatccaagattggagaacagtgggacaaagtgctcctctccaccattcctgcgtgtccctggggaagatgagcagagcagagccagacagtaaaggagagggccacgccccctccacaggttacctccttggtactcctgcccgcactacccacagcaaccccgggatgccgatctgcagccacatgtcccatgtgggaggtttctgctgaaagaacttccaactacacatctccccacttcagtataaatttcaaccttccctaattcatgcaaccttttttttttttttttttttttgagacagagtgtcgctctgtcaccgaggctggagttcagtgatgcaatctcggctcactgcaacctctacctcctgggttcaagctattctcctgtctccgcctcccaagtaactgggactacaggcgtgtgccaccactcctggctagttttttgtatttttagtagagatggggtttcaccttgttggtcaggctggtctcaaactcccaacctcaggtgatccgtccaccttgggcacccaaaatgctaggattacacacatgagctactgcacccggcctcatgcaaccttttaataaacataaaatgtcattagaaacttccagtcaggcgcggtggctcacgcccgtaatcccagcactttgggaggctgaggcgggcggatcacctgaggtcgggagttcaagaccagcctggccaacatggagaaaccccgtctctactaaaaataaaaaattagccaggcgaggtggtgcatgcctataatcccagctactcaggaggctgaggcaggagaatcatttaaacctgggaggtggaggttgtggtgagccaagatctcgccattgcactccagcctgggcaacaagagcaaaactccatctcaaaaaaaaaaagaaagaaagaaagaaagaaacttccaaataaatgttgtgacacaaaaaaaaaaacccaaacaatattcattatagagtatgcaaatgaccatgccccacccccagcagattctgatagactcccttgggtgggaatccttgtccaatatattgacacttccctttcctgtcagtatagcccagcccatgcgtgtactcacgagcggacgatggatgacacaagtacacagagggacggaatccctgcatggtgtggctatgggcaaatgtggccactgtctagattgtgcaaatgtggtggttctctggggccacagagcacacttggggacctgttcatggtgaggtctcaactccggcctctaggaacttgaatgaggacaggagggtcagagggagagcctaggaggctgagccaaggagcgtggagaggagagacagggtgaagatggcggctggctttctggaagcaggtggcctttggtgcggtcagcattcgtgccagccccctcttctctgatcctctccatgtgtctctctcctggaatcccagaagctgcccctgactccccattaactgcctctgcccctaccccctaggtgatgcttctgggagacacaggcgtcggcaaaacatgtttcctgatccaattcaaagacggggccttcctgtccggaaccttcatagccaccgtcggcatagacttcagggtgaggtggctgcaggcacttgcttccagcagagagccagggctgtggctcaggcatgggggggttgcccccaccttgctcaccctggctcccagggactcccgaggctcatgcctggagggcacacaacccgctcccccaagaccacagaggtggccgggtcaaaggagactgggcaaggttggctccttgcccaactataggatgcaaaaaaatgagactgagtcttcgattccagctccattcctgggggacttctcccaagcagagcagccgcaggcacggcataagctgaatatcttggcccacagagcccctgctcattgctctcctacctgggcccctttggaaaggcctcaaaggtcaatcagtctttctggagttcccagaaagcacagccctgcactgggtttaagagctgggcttgggccgggcatggtggctcttgcctgtattcccagcactttgggaggccgaagcggtcagatcacaaggtcaggagtttgagaccagcctggccaacatggtgaaaccccgtctctactaaaaatacaaaaattagccaggtgtagtggcacgctcctgcagtcccagctactcgggaggctgaggcaggagaatcgctcaaatccgggtggtggaggttgcagtgagctgagatcgcgccactgcactccagcctgggcaacaaagtgagactgcgtctcagaaaaaaaaaaaaaaaagagctgggctggccatgttgggagacagcagctcaccagggaccctccctctcaccttgacgactccatcttacaaatctgcatcagggatgctagacgctgcacacctgaagtgttcaatagagaaaaggtctcaccctggcaggtggggctctacagcttcaagcaggcagaaagcgaacacttccttcactagagaattagtgggcagctaaagaaaaggtgctgctgcagatgtagcctcaggtccccaggatgcaggcaaacaccccatctccaggggctcggtcacagtcccaaggctaggctccaggagagggagaccgaagtgggaaaagggcagggcctccagcagcaaccagccctccagccctgggctgcctgatccctggagagagccaggatgtttctcaggctcctcttgccctgctgttgtgagaaggcagttacagtcctcagaagggacgactccacagtggaggtgtctgggtatggggttcctgctgccctgatggtatgatctggctggagacggttctggggctcactgcacccactctaggcctggagagggaacaagacaggacgtctgcagagctgaggagccacatgactcctgccctcccatcctctgcctttttctctttcagaacaaggtggtgactgtggatggcgtgagagtgaagctgcaggtgagaccagaggctggagttggggagggaggatggaggacctgcccttccttctcaccctgaaccacaggaggcctgcagccctgccctccgcctggggcaatttcctgtggggcccacgggaggaaatggcttttgtttatttgacatctgcagaaaaagcagttcccaggcaccctctcatctatgaacagcagctccaaatgccttcagacaagcttagcctccatccatctcctccccagttgccagggctttatctgctcttaggagattggacatccccaacccctgagctaggggagaggagaagattctttttttttcttttcttttctttttttttttgagatggagtctcgctctgtcgcccaggctggagtgcagtggcacaatctcggctcactgcaacctctgcctcccaggtttaagagattctcctgcctcagcctcctgagtagctgagactacaggtgcatgccaccacacctggctaattttttgtatttttagtagagacggggtttcactgtgttagccaggatggtctggatctcctgacctcgtgatccgcctgcctcggcctcccaaagtgctgggattacaggtgtaagccaccgcgctcggctgaggagatgattttgaacgagcttgagaaatcagtaactgctactgtccaggtcattggatgctcaggggctcatgagaacctaaagaagaaaacagccccaccttcccacagatatctcatacaacaaagcaggcctgctccacccagcacattccttgcacctgcctccttctgaccatttctccatcccatcccttcccagatctgggacaccgctgggcaggaacggttccgaagcgtcacccatgcttattacagagatgctcagggtgagtccctcgcaccctccaacccctaccccagccccttggtagcatccgtgctgctgcctaagtcccctctgtgatcctctcccctccagccttgcttctgctgtatgacatcaccaacaaatcttctttcgacaacatcagggtaggtcctcccttcccctgactcccacccataagcagccaaggcaaggtctatgcaggctggggttgcttcctgccctgtggaaagcgggtggagcgtggagtcctcctgccttctgaaaaacacctacttgtgactcagaagtcatatctgctgctttgtatttggtggccatgtgggcatgaaggccaagcaggctgttgtgaccctgtgccacctgcatagccctcactgtgattcacgagtgtgtttcgtgacaaagtgttcagaacagcccccactccaccctggataattatccacagagaccaagggaaaaacacaaccagaaaagtccacacatacatccagggcaagttgcaagaaagtgactcagtcagacagagtgagtggttgtatcctcacaaccaaactattatagagacaaaaatttgataaattcaagcaccaattttgttcacgacattgtataggtttcatgaatcccctgacctcaaggacagtttgctgataagcaaactaggagaataaaacgtttatatagaaagaggaaaatccatggcactcatactcctacctccaaccccatgctcatggcagacatcactaatcaatcacagtacttttgatcactgaaacccttatgtggtcttagaatctttaacaggacactccaagaaatcactgctgacagccaactgatttgtgagataaggtctccatgcatctggatcttccatagaactgatagttgcacagcataaaatggtgagggtggggccattgtgggttgagccaccaaggaaggccatccaggcctggatgggccagaacaaaggtacagatgagagaacgcacagggtatcgtgttcaaggtagtgagtaactgaggatagtcaaacggagcagaagaagaaaggggcagcaggaggaagagaatgccagtctcgcacgccctctcccacaggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 377 - DNA, 18657 bp, Homo sapiens
  source 1..18657: mol_type = genomic DNA
tggctcattaaaaacaacacaaatttattctcctgcaattctggaggccaggagctcaagatcagtttcaatgggctcaagtcaaggcgtgggcagggctggtttcttttggaggctccaggcaggggaatccattcctttccctttctggcatctgaaggctgcggcattcatggcccctgctcacgtcacacccacgtccacttccatcatcactttgtctctacctctttgaccttctggcctctttcttatgaggacccttgtggtgatattttgggcccacctgaatcagcaagaataacctctctatctcaaagtccttaacttacatacatctgcactgtccctttctgccacagaaggtaacagtcacaggttctgaggattaggacacagatatctttgggggccattattcagcccataacatgtggtaggcaataaataaaggttcattgtattacgataatggtacttcatgataataatgataacatttttctcattatcatcttcatcattcccatgaaagccccagagcatatccctagccccctcctcaactatgtaggagaggaggggacgtttagaaaaccccaactcctagaagccccctgagacttggccccaagcccaacccagagctaggggcaatgctggctgatcaggcagaggcaccagtccccgggttggtcctgatgaggggagcagggggcagacggtcgatgaggcaggagtgtgctcacagcctggggtccaagaaggagcctggagtgcaggctaaggcctgctgatggtgctgtattccgtgggctcctcagggcccctgccggggaggtggctactgaggtggcccatgttgcagtaggtcggttcctgatcctcagcacccaaggtcagagatgcataggaaatgtcctccttcggcaaggaagcctgcagcaaaggcgggctccaggtcagagaggacggcaggaagtgacggtcacggggcagaggagccctcggaggaggatagtggggatggaccattcagggcttctaatcccactcaagccctccagcttcccccttcactctgccaagcaccctgagcttcaaccacaacagaacagattctcccccaaccctgcaccagtgcagcacatttcctgtggaatcccaagtcactcagcctgtctgggactctgctgcccacgtggggactgtgtttgccagtccctgtgtccccaggactgagacttgcctgtgggagctcctaggcgagtcctgcagtgactatggctttgccccacacctgcctcctctatgcccacatgagcaggagaaagcccaccctccaacggggtgcaacggcaggcctgtgtccccctgccccagcctcacagcagcccccatggaggacgcaccatggtgacatattccacttccacctggtcaacctgggcagaggaaagcttcgtggtagccttttgcggggaggttccggccagctgcagggtcaggtctgcatagcagaggtcgccctccaggggctgcagtacctgggacagggaacacaggctggggagtcacaagatctgtctgtggacacaggttccttttccacggtgggacgggacgagagcctctccacttccccaggtgcccctctcccatttccctccgtgtcctccacttctcaggctcctgtacccctcagcccttgtccccctggctgtttccaggccctcagcccccaggccctgcagggtgccatgaggacaggatactttggcacaggacttctctgatattttggaccttctgagagatggaaaatgaggaaggggaaagaagctgcctggtctctctggtccgaccttgggggctatcttacctgctctggggacatcccggctgctaaaagacaaacaacaattcagaattagaaagcccattccccagactcacaagaacccccaggtctagggaagagaaatatggaagaaaagaggtgaattgggtccaggctcagagacagggacctggttctaattctgattcctcagatgacacagtctgtgacattcgtcatgtcacctctctgacctttcacttctccaccaggaaaagagggacaccccagccccctgctccccacatcatagaactgtgcactcagctgatcgggtggccctgccagccatcggctcccctgggagtaagtttgcttctgcagaatcccaactcggcctggaattccaccatgtctctctacctgattcatccttcaggggtcaattcaaagtcatgcctgccttctgcagctacccaggctgtctaatccccctcccgggcccccggggggcacttgctctatgtctgtctcatcatcttcgtcctactgaattctagttagtcctcaggtgggctgtaagctgcagggtggctgggcctgtcccttccttacaacctgggtgcttggctgtgctgagcaggtggtgctccatcagtaaaagttgtctgcagagacaggaatgcaccaagctgtcccccaaccccgagtagaatgtgcaagctgggtcggcacagtagggaccgattttgtttggtttggtttggtttggtttggtttggtttggtttggtttggtttggttttgagatggagtttctctcttgtcacccatgccggagggcaatggcaccatcttggctcactgcaacctccacctcctgggttcaagcgattctcctgccttagcctcctgagtagctggaactacagatgtgtgccaccatatccagctaatttttttgcatttttagtagagaaggggtttcaccatgttggccaggctggtctcgaactcctgacctcaagtgatccacccgcctcaacctccctaagtgcggagattataggcatgagccacgacacccagagattggattggattgtttttccactgggaccgattttcaggtggttgctggtccctgtcttctttctcccctccccagccaccagccccacatccctgccctagggacaacaaagaaatggggggttttcccctggtttcaaaagtctagatgctggagaacacagaaagcacttagaccttaggccgtgggcaatacatttgggagaaaaagcgatgaataaaagtcaggctctaattttgaaaaagcatcacagaaaacaaactaacagagagtcaggctcccctcttcccaggcgaaagatttcccaggctgtggggagggagaagtgttggagggaaccctgtgagagttaggacccagctgttctagaagagaaagaggtacaattgtgtgagaatgtggaagtgaagccacattctcacacaactggggttttgttgaggccaggcctcatgatctgtgagtgtagactcctgcgccaagaggctcctccctgaagagctagttcacaaagggcaagtaggtcagcctgggaaagtccagtgggcaagggagggacagaaggaaaggccattccaatttcctgatcagacttggagggctgtgtgtgtgtgtgcatgcttgtgtaatgtgatgagtgcacatgcactgtgggatccatgcagtgtgtgtgcccatgatcgcgcatgtgtgtgtgcatccactggtgtgtttgtgtctgtttctccctccccattccatgtcagctcagtacctccttgacaaccacatagacccaactctagcgtctagtctagacaccccagactggaccacccacctaagaccattgccacctatgccatcaagagtcaatccaggaaagagacagggaggtggatcagagagaagagaaggggaaggacggaggtgcagggcaggcggcgaatgccaaaacctcctggggctcccctgcaagctccagggcgccccccggtcccctggcactgccagctgctgagggcctttgggactgtgccatttcctgattgtgtgggtaatcccttggaccagatagctcccagatgccacatccccagccacccggcccagtctcagcccagcctcacccaggtcctctcacctttctgctggtacttcatcatcctccaagccaagagtgaggcggccaccaaaagcagcagcaatatggtgaagatgaggggcaggaggacactgagcttcaggagcttgtgcctagaaacaatggcaagcgtcccctgcatcccaggctcaccacctgcctctcagcccaatcccacccacccagcagcaggggagggccacacacctgatgagctgcaggtctgtagtttgcagcctgggaaccctcactcctggggatcctcaaagatgggtttacaatgagtacacatagacacaaagaagggaatggaacaagagacaccagggcctacttgaggatggagggtgggaggaagcaaagaatcaaaaaactacaaactacctattgggtactatacctattacctgggtgacaaaataatctgtacacaaaaccccggtgacgtgcaatttaccgatataacaaatctgtacgtgtacccctgaagctaaaataaaagtttttaaaatttaagaattttaacaaaagatagttgtttttggttttctttgtttttcatttttttgacacagagtcttgctctgtcacccaggctggagtacagtggcatgatctcggctcactgcaacctccacctcccaggttcaagagattcttctgcctcagcctcccaagtagcggggattacaggcacccaccaccacacctagctaatttttgtatttttagtagagacaggattttgccatgtaagccaggctggtctcgaactcctaacctcatgatccgcccacctcagcctcccaaagtgctgggattacaggcgtgagccacagcgcccggccttaacaaaagatagtttttaaaaggagaaaagggttccatgaggtggttttaatgtgtctagaagcctaacagaaattgtagggcagcagactcctaaaacacctcctgcctctacacctgccctctctactgggttgaatagcgtcctcttcccctcgaattcacatccactcagacccgtgaatgtgacctatttgtggatgtaatcaagttaagatgaggtcatagttgattagcatgggccctgatccagcgactggtgtccttacaagagggaaatttggacacataaacacacacaggaagaagaccatgagacgacagagacagggatcagagtgatgccgccacaagaccgggaacacaaaggatcgcaggcgcccaccagcagctggaacagaggcatgagacagactctccctttgagcccccagggtggcaacagccctggtgacaccttgatttccaattcctggcctccttagctgtgagagaacgtatttcttttgctttgagccactcgtaacggcggccacaggacactgacaggccctactgtagtggatcattgccacagcagccggggggcctgtgaaccaaacgtcaaagcacacccctctctttctcaaaattctgcaacaggccaggcacagtggctcatacctgtaatcccagcaacttgggaggctgaagtaggcaggtcacttgaggtcaggagttcaagaccagcctgaccaacatggtgaaactccgtctctaccaaaaaatacaaaaattagctgggtggggtggcgtgtgtctgtaatcccagctacttgggaagctgaggtgggagaattgcttgaacccaggaggcggaggttgcagtgagctgagatcgcgccactgcactccagcctggtcgacagagcaagaccctgtctcaataaataaataaataaataaataaataaacaaacaaacaaacaatcaaaataaaataaataaataaataaatcccgtaacagccccatttcagcccatgaaaatggccagggctgacaatggcctccactcctgcctacgactcacccctgcctgcttcactccagcctcacttcctgctgctcctcaaatattccaggcacatccccacattacggaccttattccagttgcatttttctccaggaacatgctccctccagagctctgtgtggctcactttctcacctcttccagtctttgctcaagaatcactcgactgagcgcggtggcttacacctgtaatcccagcactttgggaggccgaggcaggctgatcacatgaggtcgggagttcgagaccagcctggccaacatggcaaaaccccatctctactaaaaatacaaaataacagccgggtgtggtggtgcattcctgtaatcctggctactcccagctgcttgggaggctgaggcaggagaatcgcttgaacctgggaggcgtaggttgcagtgagccgagatcctgccactgcactccagcatgggtgacagagcaacactccgtctcaaaacaaacaaacaacaaaaaaaactgttgtgggctgggctggattgtacaccaccacccccccaccccaatccatatgttgaagtcccaccctttagtatctcagaatgtgattgtatttgaagataggatctttaaagaggtgattgaggttaagtgaggtcactggggcaggccctaatccattatgactggtgtcattagaagagatcaggacacagacacacgcagagggacgaccacgtgaacacataggaaaaagatagccatctacaagctgagaagactcagaagaaaccaaccttgtggaccacttgatctcagacttttagcctccagaattgtgagaaaataaatttttgtgatttaagcccccattctgaggtattttgttaggggcaacccaagcaaactaatataaggattatctccttcatcactggatgtgcagaaatttgagaaagaaattcatcagtcaattaattgtgtcaaccctatttggttacactaattagctctagattgtaagtacctcgagggcaggcattttgattatttggtccattcttgtaccctttttaattcccttaaacagtgacaggctagagtgagtgctcaagagttatgtgttaaataaatgagtgaacaaaccatctcatgctaatcaaaggccctaatcgggcacttacataaggcttcgattcataaaataataaataaataaataaccttaactattacttattcaaagcagtttggtagaaaataaactttcaaatcagagggtatcctgtattgatttgcttaggaaaaagaaaaatagggacaaagcaaggtggcttatgcttttaatctcagcactttgggaggctgaggtgggcaaatcacttgaggacaggagttggagaccagcttggccaacataacaaaaccccatcgctactaaaaattggccgggcatggtggcttacgcctgtagttgcagctactcgagaagctgaggtatgagaatcacatgaacctgggaggtggaagttgcagtgagctgagattatactactgcactccaacctgggcaacagagtgagaatccgtcaaaaaaaaaaaaaaaaaaacaattagctgggtgtggtggtgggcgactatagttcccccagctactcaggagactgaggcatgagaattgcttgaacatgagaggcagaggttgcagtgagccaagatggcaccatgcactcaagtctgagctacagagcaagactgtctaaaaataaaaaaaaagaaaactttaaaaagtttaatttaaaaaaaaaacagaaggcaaatgggagagggggagtagaagggtctcaggtggttagaataccggggacctcccatagggattttgtggcaaggtcccagcaaaaggagaacttggcacttggcagatctaaaaacaaagtcaagagggccaaggagagtgaaaggaagaaattaaaggggacgttcctcttctagaaagcccagctgactgcagatggttgggcagggcactaagaggcatgacctgagctatggtgtagagcccagagacttccatccaagctccagcaccacccttcactgaggaagggactgaggctcagtttcttcttctgtaaaatgggaacatttgtatctgcccattcttccacatggggtggttgtaggaaaggtcaaagaaaacaaaataatgcacaggaaagccttttgtgagctgtcagttgctctagagatgtgagaaactataggcatcactgttcttgccataatagtaatcagaggaaaattaagggaaacaggacttccccaagccctcctttccttgtcctcccagaagttgaaccaagagtcatccctgcggctccatgaccccacgcccacactcacatgagacacactgtcctcactgactgccaactcatcggtctcccacactgagctccacggggacagtccatgtctgtgtccccagagctcagcacggtgcagccatgtagaagttattataacacagtaaaagtggggcgaacgaatgaatgaacctacaaacagcactgagctgcagaatgaaggatctgtggagactgaaaggacaccatgtggcctgacagcaagtgggaagggctcccagcttcctcatcctcaccaaggagcatgcaggtcccagacaaagctcaggctggaaaatgggacttcaaagagttctccattggaggagtttgggccaagtaggccacagtggaaccagagctggcttacctgttgtccaagtggtggccggtcagagttggggagctgctagtttcttcttgggtgactggtgctgtaaacgtagtggaggtaggcgtggtgggggcaggagtcgacgctgtagttgatgcttggtgtataaaccagatcacagatgcccctgcccatgagcccacccgcagccctgcacacagctctgagcctgggcgggggtctggactgctactatgggaaggggctgcagcctggaccactcatgtctccctggtctctaggagactccagagcctcataggcaggtggggctgggcagggtccagggaggacgctgagctggccctgggagggttagagggggctgggaagagcctaagggcagctggagaccagctgaacttgagcaacctgctgcttatgacagtgccttggtcaatctccacccccagccctatttatccagcaaaaacaggagcagagtgggaacttgcacagtgaccctagatctgtgacatcaaaggtcaggaccagccctgaatgaaatcatcatattcaggaagaactttgactttgggcaagttacaaaacttcaatgatggggatgcccccttctcaggggtattgtgaggacccattgagacaatgcacgttcagcactttgcaaactagaatatgccccagaggctccgggtgcaacctggggccccaaggactgtggtgctccttccatgccacaagggccctcgagccatcctgcttatcttctgagggacagcagaacaagcccaacaaataaacccatgcaaaccgaggcactgggacccctgagctaacgctcccaggagtgtctgcattctagaaggacataggaagaaatatcattaagtccacacacacaaatggctcatggtgggatgtcagggaccaggaatgcagccgtttgactgtgaagacctttctggacttgggaattagaccccagcaccccgactatgctgagcctctttttcccccaggttagatatggaatgggagatgggaacagcagctatgaagccccagcccagaactccaccaaaagcaggacacacctgggcaccagaggtctccaaaaagcaatggcaaggactggggtctctgggtaccatgggaaggcatccctttggcccatgggctgaaactgggaccatcaccttgtcctcaggcactgagctgtgcagaggtaaaaaatgtgcctagaaaggcttaatcccgtcgtggagggagccctgggagccatgggggcattgaagagaggccctgctcccccagtcccaggtggtcagtcagggttctatgagactcgggactcaagtgatagatcactcagtgacaattaaatcacttgagtaggacctcagagaccaggacagagcaggccctgagagacacacacatatatacactccctcttacctgggtcaatggtcacttgaactgtgaccccaaggtcatttccagttttctcaattccacaccagtaagtgtcagcatcagttttcatgagatcctccatggtcacagtgaacgtgcggtttttctgattgtccttgatggacacccggtccctcttcacctcctgctctgacccactggttttaacaaggatcttgcagtcacgccaaatagctcctcgacaccaccacttcaagtaggtctcccagcctgatctgtaaacacactgcacggtcaaggagccccgctccaagccattcactgttgttggaccggtgatttgagtgacaatggagtagcctggaaaacacaaattcatgtgctgtcacctcccaccccaagggcagggccacagctttctgtttagggaatagctcccaaatccaagtttcacaggttaaataacagtcaaggaagaaatacaccttccgcagacaaaacttttgtccttcagctttccactgggtcaaagccaccaggaaaatcactgaagagcacaacaacggatccccccaaaaataaaaatattggcataagcaataataacttcctgcagttcacccctctctccaccctacggccaaggtaatctgtatatttcaaggaatgtccttttgcagccatctttgtgttagtccagtgtggtggggaggaaataccaggagacccctttccacagggtcttaccttgactcttagcactgatgaccctcatgaggtcgagctgaggcagccacatcagatggctgtggagaggctgtcctggtggtcctaatgatttctagtggttctggaataaaccaccctggatgaatgcctttgaagttgatcaaaacagcaacggcaactggtctccatgtgctataggatccatacaacacagatcccactttctttaatgaattgctttgacccctttgtcaaattgcaaatttgtggatttcccattctgttccattgatctatttgtccacctttctgccaatcctacattctcctgattactatcaccttgtagaaaagcaggtattatagacagtaaggcagtatttacttttttttttctttttctctttttttcttttgaaacaggctctcactctgtcgcccaggctggaacacagtggcacaatcatggctcaatcatggctcactgaagccttcacctcccaggcttaattgatcctcccacttcagcctcccaagtagctgggactacaggcacatgcctccacgcctggctaatttttgtagttttagtagaaacaggattttgccatgttgtccaagctggtctcaaactcccgggctcaagcgatccacccacctcagcctcacaaagtgttgggattacaggcgggccccacaacgcctggcctgtattttcttaaaatacatgttttccttcaaaatcatgtcctttgcagcaacatggatgtggctggaggccattatcctaagtgaattaacgcagaaacagaaaaccaaataccgcatgttctcacttataagtgggagctaaacattggttatgcatggacataaagatgggaacaacaggcagaggagggaaaggggcaagaacaaaacagaggagggaagggagcaagcactgaaaaaactaccaattgggtaccatgttcactatctgggtgacaggtttgattgaggctcaaacctcagcatcatgcaatatatccatgtaacaaacctgcacaggtacccactgactctaaaaataaaaaacattttaaaggaaaaaaaaaatatatatatatatatatcccaaagtgctgcgattataggtgtgagcaactgtgcctggccttttttttttttttaagtaaagaaatatttccctgtatccggaatctttcaaaggtgagaatatgagagaaagaataaaaagaacatatatatataaattcccaacatgaggttgggagttcgagatcagcctgaccaacatggagaaacgccatctctactaaacatagaaaaattagcctggcatgatggcacatgcctgtaatcccagctactcgggaggctgaggcaagagaatcgcttgaacccgggaggcagaggttgcaatgagccaagatggcgccatagcactccagcctgggcaacaagagcaaaactccatctcaaaaacaaaacaaaacaaaacaaaaaccagcagttcaagcacaacaaccaacggcgcggacagagggcctcagtgtcagagagaccctgggaaggggtgaggaccacggcagcctggattggagagcagggtatccatgcgaaggcacagccctccttccactccagcccgggtcctggggaaagaagcgggccctgtgacaagaacacacaatggggaaaggacagtctcttcaataaacagtgctgggaaaactcgacatccacgtccagaagaatgaagccggacctttatctcacaacatatacaaaaatcaactcacaatagagaagatgtaaatgtaagacctgaaacttaaatctctcagaagaaaacctaatggaaaagctccacaacattggtcttggcgatgatgtcttggagaggacgccaaaagcacaggcaacaaaagcaaaactagacaaatgggactcacaaaaccaaagagcttctgcacagcaaaggaaacaaccaagagaatgaagcgacaacctacagagtgagagaaaatatttgcaaaccataaatctgacaaagagctgatatccaaaatacataaggaactcaaacaaatcagtaacaagaaaacaaataatctaattaaaaactgggcaaggaatctgaccagatatttctcaaaagaggagctataaatgggcaacagatctatttttaaatgctcaacatctctgatcaccagaaaaatgcaaattaaaaccaaaagagggtcaggcacagtattcacacttgtaattccagcactttgggaggccacattgggtggatcatctgaagtcaggagtttgagaccagcctaggcaacatggtgaaatcttgtctctactaaaaatacaaaaattaaccaggtgtggtggagtgcacctgtaatcccagctacttgggaggctgaggtgggagaatcgtctgaacctgggaggcggaggttgcagtgagccaagatcgtgccactgcattccagcccgagcaacagagtgagactccatctcagaaaaaaaaaaaaaaattaaaagtggtatatgactgtatatcctgcacatattaaaaagttaataaaccatgaataagataaaaggatataataataaaaggatatttaaacaatgttatgccaatgaatttacaatttgagatggaataaacaaattcctagaaaaaaattatacaggccaggcactgtgagaggccgaggcaggtggatcacctgaagtcaggagttcaagaccagcctggccaacatggtgaaaccccatctctactaaaaatacaaaaattagcctggcgtggtggcacacacctgtagccccagccacttgggagactgagacaggagaatcgcttgaacccaggaggtggaagtttcagtgagccgagatcacatcactgcactccaggctgaacaacagaacaagactccatctcaaaaaaaaaaaaaagaaaaaagaaaaagaaagaaaagaaaaaaaatacaatatgctaaaatcagcacaaaataaatagaaaacctgaatcattccacagctattatatttaaataaatcaaatcccttgtttaaaacttccgccagaataaaactccagacccatacagcttcaatggaaatatttaccaaacacgtaaagaagaaataatgtctattttatagataattttccagagcatagaaaaagaagatgaaatcccaaatccatttcacgagattaacataatcttgatgccaaaacctgacaagggcaaagcaagaaagtattgtaggcaaatatcactcattaacataaatgcaaaaacctgaaacaaaagatcagcatacggaatctggtgatacataaacaggataaaacattatcaccaagttgggtttatgccaaacacccaaaatggtttttaacattaaaaaatcaataaggaggctggacgcggtggcttacaccggtaatcccagcattttgggaggccaaggcgggcggatcaggaggtgaggagatcgagaccatcctggctaacacggtgaaaccctgtctctactaaaaatacaaaaaattagccaggcgtggtggcgggcgcctgtagtcccagctactcggaggctgaggcaggagaatgacgtgaacccgggggggcggagcttgcagtgagccgagatcgcgccactgcactccagcctgggcgacagagcaagactccgtctcaaaaaaaaaaaggaaaatcaataaggaggccaggcacggtggtttacacctgcaatcccagcactttgggagtccgagtcaggcagatcacgaggccaagagatcgagacaatcctggccaacatggtgaaaccccgtctctactaaaaattcaaaaaattagctgggcgtggtggcgggcgcctgtagtcccagctgctcgggaggctgaggcaggagaatcgcttaaacccaggaggcggaggttgcagtgagccaagatcacaccactgcactccagcctggagacagagcaagactgactcaaaaaaaaaaaggaaaaaagaaaatcaataagggtaatatgccatattaacagagtcaaggagaaaaatcttgtgatcatcttaggtgcagagagaagtagtgataggaatcaacgctcattcatgattttttaaaaactcttagcaaactaagagaactgcctttatctgataaagattgtctatcaaaaacctcagcaagcaccacacttagtgcgagacattcatatgtactttataataatttgttaacatggatgttgaagttttatgcacttttttgtacattttattttccacaattaaaaagacttttaggacaccataaaccaagagccaaattattcttttttttttgagatggagtcttgcttggtcgcctgtcacccaggccggagtgcactggtacgaacatgggtcactgcagcctcaagtcctgggctcaagtgatccttttgctgtaacctcttatgtagctgggacgacaggaccacaggcatgcaccaccataccaggctagtatttttttttttggagagacaaggtctcactttgttgcccaagctggtctcaaactcctggactcaaccgatctgcctgccttagcctcacaaagtgctgggattacaggcttgagccatcatgcatcaccagccaaattattcttaacagtgaaatactataggcattcctattgacatcataaacaaaacatgaattcccaatatatataataacatgattctggaagttcttttttgtttgtttgtttttttgagatggagtcaggctctgtcgcccaggctggagtgcagtggctcaatctcggctcactgcaagttccgcctcccgggttcacgccattctcctgcctcagcctcctgagtagctgggactacaggcgcccaccaccacgcccagctaattttttgtacttttggtagagatggggtttcaccgtagccaggatggtctcgatctcctgaccttgtgatccgcctgccttggcctcccaaagtgctgggattacaggcgtgagccactgtgcccagcctggaaattctaatcaatataggaagataaggaaaaacataaaatgtataattatcaaaagggaaaaaagttagagaaaattttttaattttaaatgaaaaagtattttaattcataattgaatttaatagagtggctaaataataaacatgtaaaaatcaatggctttcctataaactgctaataaatagttggaaagtaaagtagaaaagtgctcatttacattagcaataaaagtgtattaaattcctaggaataactttaacagaaacaataaagacttatggaaaaaaagcacagtgaggctgggcgcggtggctcacgcctgtaatcccaacactttgggaggccaaggcgggtggatcacttgaggtcaggagttcgagaccagcctaaccaacatggtaaaaccccatctctactaaaaatacgaaaaaaaaaaaaaaatagccaggcatgctggcacacctgtaatcccagctacttgggaggctgaggcagaagaatcacttgaatctgggaggcagaggttgcagtgagccaagatcgcgccactgcactccagcctgagtgacagagcgagactctgtctcaaaaaaaaaaacaaaaaatctgttcttgccaggcacggtggctcatgcttttaatcccagcaactcagacggccaaggcaggaggatcacttgagcccaggagttgaggctgcagtgagctatgatcatgccaccacactccagcctaggcaacagactgagaccccaactcaaaaaaaataaaaaaccttcctttctcacagaaaacaaacttccggatgggtattttttttcttgggtgttttaaaacgataaattatttagaagagggaaacagggtaagcacacttgctgcttgtgggtggaagttctgcaggagaggctggcaagagctgatgcatgcaggttcacagtggtatccgggctccatgttggcgcccatagctgtgcctgctggcttttctgcccacttcagacagaggtcccaaaccactcccactcccaacacgactctcacatctgctcactaccaaattctctcatttccaggtgtcagaaaaaaagcagccatacctgtcctggtctcactgtgccaatgcatttcataacatctcacccaaagtctgccttctccacttacatgctgaaactcggggccaagtgtccatgagccactccctgctcttcctgtaccagcctagcagtcctggacaagtcactttcttccccaagaccttttctccaatctgtcccaccaggatcttctgaagcatgaggcaaagccgtgctgacctccctcttcctcagacgtgcccagtccaagctcattcctacacaagagccctcgtatctactgttccctgtgcctggaaagctggtcccgatcctgtgtctgatccttttcctaggtctcggctcggacaggcatctgggaccctcttcaggggggttgtttcagcccacctgacttacagcatccccctacctgggtcccactgtaacatatcatcttgttctgttttcctcacagtacttatcacttctcacttcttgaaattatttttttgttttctttctttttttttcttttttcttttttcttttttttttttttttgaaacagagtctcgctctgtcacccatgctggaaggcagtagtgtgattacaggtcactgcagcctccaactcctgggctcaagtgatcctcatgcctcagcctccagcctcccaagtagctgggaccataggcacatgccaccatacctggctaatttttgtactttttgtagagacagggtttccacatgttacccaagctggtctcgaatccctgagctcaagcaatcagcctcccaaagtgctgggattacaggaatgagcctctttccctggcctcccttcatttttaataaaaattgtatgcaccaacttaaggtgtctcctgccctctggctctgcccacatctcagtccctcctttcctctacgtccctgccagtcttatctcctcttgacctttccgtccctcagcaacttctactatttccttctgccccaaatgcctagaaccaccactccctctctgcccagcaaactccctcttccctcctttcaaagtcctccagcctcacctcttccctgacgcctgcccttgctcagaacacctccacgcaggtgacagatcacccagtccaggatcaggcagtcgcctgctctcctgagcagcccatgttcctcctctgcttttccctggccggcggggcctacagtctgtccatttcacatgatcagcccctgggggtcaggaattctgccttgcactggcttcattatgaaggtcatgccctgtattcctgccttggcaacggaaatgctaggtgaatggtgggtatgtggatgaaacgcacaaggctcatgccattaaggacaccttctggccgggtcccttcttccctctctcagccacctcctcctgcttgctaagcttccccaagaagacagacccaggcccgctcacctgagagccagaagaggagcaggtagagtgtcagcaggggcatcttctcttcagacaggtccccgttcccctcagtggagcctggcagcaggaacaaactacagactcccagccttctgctggtactcactctcgcccttgaactt

SEQ ID NO: 378 - DNA, 10516 bp, Homo sapiens
  source 1..10516: mol_type = genomic DNA
ggaggcgcagcccaggggtccccagctccccgcctcgccacctggggacagcccacggcccggggctcgggcgccgcctgctgtcgcggtgcgcagcgactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaaggtccgagccggtgtcgtcgagggggcgacgggacggagggaggagcctgaggggtcccggtcgagggaggggaggagtgggcggggcgggggtggggccgttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgggtgggcctcttccgtgagacccccgccctcctcggcgctagccccttcctggctgcgtctgggttggactcagcccttcccccaggcagctgcgtctcccagaggagggagggagagagggtcaggacacagcctctggggccgtcccaagctctaggtgtctctgctggcttggtgggggcgggtcgcggaagatcgcaaaaactgagtgatccccccgccggccccaactcagttctcttctgccacactctggcaaatatgagcccccgggagcccatgcttcttggtgagggttaagcgcgcaactctcggggctcaggctgggaagggctgggagatggggaccgaacggagactcggagaggacgtcccctgctggcagaggaactggcgttaatgccattttccgagctaagctcttagttgagatctgacatccaggtttaaggcctgatgtcccccagctgctcccctcccattccacccgctggaggcactgcctcccaccttcctccctgcagtcggaagccgctcctcccagaaggatgttgccagccggcctgcaggtcacttgggaatttttcgaacctgagaaagatttcagtggttggtctttcgcatcccgcacttgagagagctccagggctgctctctggggcttgctccctctacaggggtgtcctgtatggaaacaggtagggacagcagtggactggtctgtcgccttccatctgtgtccttggagtgagcgggtaccagaaactgaaagaactgctgagggagcctagagcttccactcttcctctgcagggttggggatggagtgagggctgtcctggattccgctgcatggccttgaaggagacctgcctctctctgggcctcggtttcctccccgacaccagggctcacccttgctgggagcctcagcctccaccccagtgtttcgggggaagccaccctgcaagtcatccgcccagagccgttgagataggcgtcctgtgtgggcttgtggcaggaaatgggcccctgcaccctcggagaggaggagctgctgttggccaggccccaggctgagggggactgcctgaccttgttgccctgcaaaccagctgggttgtttgcctaggaggtggccaggctaggcagctgtttgtgtttggtggaatcaccgagctgggtgggtagctggcatcgtttgctcaaggcagctgtgatctgtaaagtacacaaagactggccctccctccctccttcctgctccagggctgggacccaggagccagggaggagtgcaggctccagaaagctcctatcccccaccccttcatctgttccctggccaagcggcattggccggagagttggtccccagcctccccgggcctgccccaggggagtgagtccaggaccctctgagaaagcctggcaggagctccttggaccagactaggggtgatgtggcccacaggcagacagttcccaccctgggccactcttccctgggtcttaggtgattcaccacgatgatgggccctagccattaacagactctagaaatacctcaaagacattatccctcctccttctacccactatggaaaccatgccacagaaaggttaaggaatcttcctaaagtcacacagtaggccatttacaaatcaagacccatccttcataccccttctgctcagccacccctgcctctccaccagagttaactaatgccagtaccccatgcccacaacaggaatgcctttgggctccactgtcaatttcagagcctcaaaaataattcaaacctagtccctgcttaacccattaagccacctaaccagcagctgggaaattccagcattggatctagacccctgttatccaagattggagaacagtgggacaaagtgctcctctccaccattcctgcgtgtccctggggaagatgagcagagcagagccagacagtaaaggagagggccacgccccctccacaggttacctccttggtactcctgcccgcactacccacagcaaccccgggatgccgatctgcagccacatgtcccatgtgggaggtttctgctgaaagaacttccaactacacatctccccacttcagtataaatttcaaccttccctaattcatgcaaccttttttttttttttttttttttgagacagagtgtcgctctgtcaccgaggctggagttcagtgatgcaatctcggctcactgcaacctctacctcctgggttcaagctattctcctgtctccgcctcccaagtaactgggactacaggcgtgtgccaccactcctggctagttttttgtatttttagtagagatggggtttcaccttgttggtcaggctggtctcaaactcccaacctcaggtgatccgtccaccttgggcacccaaaatgctaggattacacacatgagctactgcacccggcctcatgcaaccttttaataaacataaaatgtcattagaaacttccagtcaggcgcggtggctcacgcccgtaatcccagcactttgggaggctgaggcgggcggatcacctgaggtcgggagttcaagaccagcctggccaacatggagaaaccccgtctctactaaaaataaaaaattagccaggcgaggtggtgcatgcctataatcccagctactcaggaggctgaggcaggagaatcatttaaacctgggaggtggaggttgtggtgagccaagatctcgccattgcactccagcctgggcaacaagagcaaaactccatctcaaaaaaaaaaagaaagaaagaaagaaagaaacttccaaataaatgttgtgacacaaaaaaaaaaacccaaacaatattcattatagagtatgcaaatgaccatgccccacccccagcagattctgatagactcccttgggtgggaatccttgtccaatatattgacacttccctttcctgtcagtatagcccagcccatgcgtgtactcacgagcggacgatggatgacacaagtacacagagggacggaatccctgcatggtgtggctatgggcaaatgtggccactgtctagattgtgcaaatgtggtggttctctggggccacagagcacacttggggacctgttcatggtgaggtctcaactccggcctctaggaacttgaatgaggacaggagggtcagagggagagcctaggaggctgagccaaggagcgtggagaggagagacagggtgaagatggcggctggctttctggaagcaggtggcctttggtgcggtcagcattcgtgccagccccctcttctctgatcctctccatgtgtctctctcctggaatcccagaagctgcccctgactccccattaactgcctctgcccctaccccctaggtgatgcttctgggagacacaggcgtcggcaaaacatgtttcctgatccaattcaaagacggggccttcctgtccggaaccttcatagccaccgtcggcatagacttcagggtgaggtggctgcaggcacttgcttccagcagagagccagggctgtggctcaggcatgggggggttgcccccaccttgctcaccctggctcccagggactcccgaggctcatgcctggagggcacacaacccgctcccccaagaccacagaggtggccgggtcaaaggagactgggcaaggttggctccttgcccaactataggatgcaaaaaaatgagactgagtcttcgattccagctccattcctgggggacttctcccaagcagagcagccgcaggcacggcataagctgaatatcttggcccacagagcccctgctcattgctctcctacctgggcccctttggaaaggcctcaaaggtcaatcagtctttctggagttcccagaaagcacagccctgcactgggtttaagagctgggcttgggccgggcatggtggctcttgcctgtattcccagcactttgggaggccgaagcggtcagatcacaaggtcaggagtttgagaccagcctggccaacatggtgaaaccccgtctctactaaaaatacaaaaattagccaggtgtagtggcacgctcctgcagtcccagctactcgggaggctgaggcaggagaatcgctcaaatccgggtggtggaggttgcagtgagctgagatcgcgccactgcactccagcctgggcaacaaagtgagactgcgtctcagaaaaaaaaaaaaaaaagagctgggctggccatgttgggagacagcagctcaccagggaccctccctctcaccttgacgactccatcttacaaatctgcatcagggatgctagacgctgcacacctgaagtgttcaatagagaaaaggtctcaccctggcaggtggggctctacagcttcaagcaggcagaaagcgaacacttccttcactagagaattagtgggcagctaaagaaaaggtgctgctgcagatgtagcctcaggtccccaggatgcaggcaaacaccccatctccaggggctcggtcacagtcccaaggctaggctccaggagagggagaccgaagtgggaaaagggcagggcctccagcagcaaccagccctccagccctgggctgcctgatccctggagagagccaggatgtttctcaggctcctcttgccctgctgttgtgagaaggcagttacagtcctcagaagggacgactccacagtggaggtgtctgggtatggggttcctgctgccctgatggtatgatctggctggagacggttctggggctcactgcacccactctaggcctggagagggaacaagacaggacgtctgcagagctgaggagccacatgactcctgccctcccatcctctgcctttttctctttcagaacaaggtggtgactgtggatggcgtgagagtgaagctgcaggtgagaccagaggctggagttggggagggaggatggaggacctgcccttccttctcaccctgaaccacaggaggcctgcagccctgccctccgcctggggcaatttcctgtggggcccacgggaggaaatggcttttgtttatttgacatctgcagaaaaagcagttcccaggcaccctctcatctatgaacagcagctccaaatgccttcagacaagcttagcctccatccatctcctccccagttgccagggctttatctgctcttaggagattggacatccccaacccctgagctaggggagaggagaagattctttttttttcttttcttttctttttttttttgagatggagtctcgctctgtcgcccaggctggagtgcagtggcacaatctcggctcactgcaacctctgcctcccaggtttaagagattctcctgcctcagcctcctgagtagctgagactacaggtgcatgccaccacacctggctaattttttgtatttttagtagagacggggtttcactgtgttagccaggatggtctggatctcctgacctcgtgatccgcctgcctcggcctcccaaagtgctgggattacaggtgtaagccaccgcgctcggctgaggagatgattttgaacgagcttgagaaatcagtaactgctactgtccaggtcattggatgctcaggggctcatgagaacctaaagaagaaaacagccccaccttcccacagatatctcatacaacaaagcaggcctgctccacccagcacattccttgcacctgcctccttctgaccatttctccatcccatcccttcccagatctgggacaccgctgggcaggaacggttccgaagcgtcacccatgcttattacagagatgctcagggtgagtccctcgcaccctccaacccctaccccagccccttggtagcatccgtgctgctgcctaagtcccctctgtgatcctctcccctccagccttgcttctgctgtatgacatcaccaacaaatcttctttcgacaacatcagggtaggtcctcccttcccctgactcccacccataagcagccaaggcaaggtctatgcaggctggggttgcttcctgccctgtggaaagcgggtggagcgtggagtcctcctgccttctgaaaaacacctacttgtgactcagaagtcatatctgctgctttgtatttggtggccatgtgggcatgaaggccaagcaggctgttgtgaccctgtgccacctgcatagccctcactgtgattcacgagtgtgtttcgtgacaaagtgttcagaacagcccccactccaccctggataattatccacagagaccaagggaaaaacacaaccagaaaagtccacacatacatccagggcaagttgcaagaaagtgactcagtcagacagagtgagtggttgtatcctcacaaccaaactattatagagacaaaaatttgataaattcaagcaccaattttgttcacgacattgtataggtttcatgaatcccctgacctcaaggacagtttgctgataagcaaactaggagaataaaacgtttatatagaaagaggaaaatccatggcactcatactcctacctccaaccccatgctcatggcagacatcactaatcaatcacagtacttttgatcactgaaacccttatgtggtcttagaatctttaacaggacactccaagaaatcactgctgacagccaactgatttgtgagataaggtctccatgcatctggatcttccatagaactgatagttgcacagcataaaatggtgagggtggggccattgtgggttgagccaccaaggaaggccatccaggcctggatgggccagaacaaaggtacagatgagagaacgcacagggtatcgtgttcaaggtagtgagtaactgaggatagtcaaacggagcagaagaagaaaggggcagcaggaggaagagaatgccagtctcgcacgccctctcccacaggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 379 - DNA, 10119 bp, Homo sapiens
  source 1..10119: mol_type = genomic DNA
gttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgggtgggcctcttccgtgagacccccgccctcctcggcgctagccccttcctggctgcgtctgggttggactcagcccttcccccaggcagctgcgtctcccagaggagggagggagagagggtcaggacacagcctctggggccgtcccaagctctaggtgtctctgctggcttggtgggggcgggtcgcggaagatcgcaaaaactgagtgatccccccgccggccccaactcagttctcttctgccacactctggcaaatatgagcccccgggagcccatgcttcttggtgagggttaagcgcgcaactctcggggctcaggctgggaagggctgggagatggggaccgaacggagactcggagaggacgtcccctgctggcagaggaactggcgttaatgccattttccgagctaagctcttagttgagatctgacatccaggtttaaggcctgatgtcccccagctgctcccctcccattccacccgctggaggcactgcctcccaccttcctccctgcagtcggaagccgctcctcccagaaggatgttgccagccggcctgcaggtcacttgggaatttttcgaacctgagaaagatttcagtggttggtctttcgcatcccgcacttgagagagctccagggctgctctctggggcttgctccctctacaggggtgtcctgtatggaaacaggtagggacagcagtggactggtctgtcgccttccatctgtgtccttggagtgagcgggtaccagaaactgaaagaactgctgagggagcctagagcttccactcttcctctgcagggttggggatggagtgagggctgtcctggattccgctgcatggccttgaaggagacctgcctctctctgggcctcggtttcctccccgacaccagggctcacccttgctgggagcctcagcctccaccccagtgtttcgggggaagccaccctgcaagtcatccgcccagagccgttgagataggcgtcctgtgtgggcttgtggcaggaaatgggcccctgcaccctcggagaggaggagctgctgttggccaggccccaggctgagggggactgcctgaccttgttgccctgcaaaccagctgggttgtttgcctaggaggtggccaggctaggcagctgtttgtgtttggtggaatcaccgagctgggtgggtagctggcatcgtttgctcaaggcagctgtgatctgtaaagtacacaaagactggccctccctccctccttcctgctccagggctgggacccaggagccagggaggagtgcaggctccagaaagctcctatcccccaccccttcatctgttccctggccaagcggcattggccggagagttggtccccagcctccccgggcctgccccaggggagtgagtccaggaccctctgagaaagcctggcaggagctccttggaccagactaggggtgatgtggcccacaggcagacagttcccaccctgggccactcttccctgggtcttaggtgattcaccacgatgatgggccctagccattaacagactctagaaatacctcaaagacattatccctcctccttctacccactatggaaaccatgccacagaaaggttaaggaatcttcctaaagtcacacagtaggccatttacaaatcaagacccatccttcataccccttctgctcagccacccctgcctctccaccagagttaactaatgccagtaccccatgcccacaacaggaatgcctttgggctccactgtcaatttcagagcctcaaaaataattcaaacctagtccctgcttaacccattaagccacctaaccagcagctgggaaattccagcattggatctagacccctgttatccaagattggagaacagtgggacaaagtgctcctctccaccattcctgcgtgtccctggggaagatgagcagagcagagccagacagtaaaggagagggccacgccccctccacaggttacctccttggtactcctgcccgcactacccacagcaaccccgggatgccgatctgcagccacatgtcccatgtgggaggtttctgctgaaagaacttccaactacacatctccccacttcagtataaatttcaaccttccctaattcatgcaaccttttttttttttttttttttttgagacagagtgtcgctctgtcaccgaggctggagttcagtgatgcaatctcggctcactgcaacctctacctcctgggttcaagctattctcctgtctccgcctcccaagtaactgggactacaggcgtgtgccaccactcctggctagttttttgtatttttagtagagatggggtttcaccttgttggtcaggctggtctcaaactcccaacctcaggtgatccgtccaccttgggcacccaaaatgctaggattacacacatgagctactgcacccggcctcatgcaaccttttaataaacataaaatgtcattagaaacttccagtcaggcgcggtggctcacgcccgtaatcccagcactttgggaggctgaggcgggcggatcacctgaggtcgggagttcaagaccagcctggccaacatggagaaaccccgtctctactaaaaataaaaaattagccaggcgaggtggtgcatgcctataatcccagctactcaggaggctgaggcaggagaatcatttaaacctgggaggtggaggttgtggtgagccaagatctcgccattgcactccagcctgggcaacaagagcaaaactccatctcaaaaaaaaaaagaaagaaagaaagaaagaaacttccaaataaatgttgtgacacaaaaaaaaaaacccaaacaatattcattatagagtatgcaaatgaccatgccccacccccagcagattctgatagactcccttgggtgggaatccttgtccaatatattgacacttccctttcctgtcagtatagcccagcccatgcgtgtactcacgagcggacgatggatgacacaagtacacagagggacggaatccctgcatggtgtggctatgggcaaatgtggccactgtctagattgtgcaaatgtggtggttctctggggccacagagcacacttggggacctgttcatggtgaggtctcaactccggcctctaggaacttgaatgaggacaggagggtcagagggagagcctaggaggctgagccaaggagcgtggagaggagagacagggtgaagatggcggctggctttctggaagcaggtggcctttggtgcggtcagcattcgtgccagccccctcttctctgatcctctccatgtgtctctctcctggaatcccagaagctgcccctgactccccattaactgcctctgcccctaccccctaggtgatgcttctgggagacacaggcgtcggcaaaacatgtttcctgatccaattcaaagacggggccttcctgtccggaaccttcatagccaccgtcggcatagacttcagggtgaggtggctgcaggcacttgcttccagcagagagccagggctgtggctcaggcatgggggggttgcccccaccttgctcaccctggctcccagggactcccgaggctcatgcctggagggcacacaacccgctcccccaagaccacagaggtggccgggtcaaaggagactgggcaaggttggctccttgcccaactataggatgcaaaaaaatgagactgagtcttcgattccagctccattcctgggggacttctcccaagcagagcagccgcaggcacggcataagctgaatatcttggcccacagagcccctgctcattgctctcctacctgggcccctttggaaaggcctcaaaggtcaatcagtctttctggagttcccagaaagcacagccctgcactgggtttaagagctgggcttgggccgggcatggtggctcttgcctgtattcccagcactttgggaggccgaagcggtcagatcacaaggtcaggagtttgagaccagcctggccaacatggtgaaaccccgtctctactaaaaatacaaaaattagccaggtgtagtggcacgctcctgcagtcccagctactcgggaggctgaggcaggagaatcgctcaaatccgggtggtggaggttgcagtgagctgagatcgcgccactgcactccagcctgggcaacaaagtgagactgcgtctcagaaaaaaaaaaaaaaaagagctgggctggccatgttgggagacagcagctcaccagggaccctccctctcaccttgacgactccatcttacaaatctgcatcagggatgctagacgctgcacacctgaagtgttcaatagagaaaaggtctcaccctggcaggtggggctctacagcttcaagcaggcagaaagcgaacacttccttcactagagaattagtgggcagctaaagaaaaggtgctgctgcagatgtagcctcaggtccccaggatgcaggcaaacaccccatctccaggggctcggtcacagtcccaaggctaggctccaggagagggagaccgaagtgggaaaagggcagggcctccagcagcaaccagccctccagccctgggctgcctgatccctggagagagccaggatgtttctcaggctcctcttgccctgctgttgtgagaaggcagttacagtcctcagaagggacgactccacagtggaggtgtctgggtatggggttcctgctgccctgatggtatgatctggctggagacggttctggggctcactgcacccactctaggcctggagagggaacaagacaggacgtctgcagagctgaggagccacatgactcctgccctcccatcctctgcctttttctctttcagaacaaggtggtgactgtggatggcgtgagagtgaagctgcaggtgagaccagaggctggagttggggagggaggatggaggacctgcccttccttctcaccctgaaccacaggaggcctgcagccctgccctccgcctggggcaatttcctgtggggcccacgggaggaaatggcttttgtttatttgacatctgcagaaaaagcagttcccaggcaccctctcatctatgaacagcagctccaaatgccttcagacaagcttagcctccatccatctcctccccagttgccagggctttatctgctcttaggagattggacatccccaacccctgagctaggggagaggagaagattctttttttttcttttcttttctttttttttttgagatggagtctcgctctgtcgcccaggctggagtgcagtggcacaatctcggctcactgcaacctctgcctcccaggtttaagagattctcctgcctcagcctcctgagtagctgagactacaggtgcatgccaccacacctggctaattttttgtatttttagtagagacggggtttcactgtgttagccaggatggtctggatctcctgacctcgtgatccgcctgcctcggcctcccaaagtgctgggattacaggtgtaagccaccgcgctcggctgaggagatgattttgaacgagcttgagaaatcagtaactgctactgtccaggtcattggatgctcaggggctcatgagaacctaaagaagaaaacagccccaccttcccacagatatctcatacaacaaagcaggcctgctccacccagcacattccttgcacctgcctccttctgaccatttctccatcccatcccttcccagatctgggacaccgctgggcaggaacggttccgaagcgtcacccatgcttattacagagatgctcagggtgagtccctcgcaccctccaacccctaccccagccccttggtagcatccgtgctgctgcctaagtcccctctgtgatcctctcccctccagccttgcttctgctgtatgacatcaccaacaaatcttctttcgacaacatcagggtaggtcctcccttcccctgactcccacccataagcagccaaggcaaggtctatgcaggctggggttgcttcctgccctgtggaaagcgggtggagcgtggagtcctcctgccttctgaaaaacacctacttgtgactcagaagtcatatctgctgctttgtatttggtggccatgtgggcatgaaggccaagcaggctgttgtgaccctgtgccacctgcatagccctcactgtgattcacgagtgtgtttcgtgacaaagtgttcagaacagcccccactccaccctggataattatccacagagaccaagggaaaaacacaaccagaaaagtccacacatacatccagggcaagttgcaagaaagtgactcagtcagacagagtgagtggttgtatcctcacaaccaaactattatagagacaaaaatttgataaattcaagcaccaattttgttcacgacattgtataggtttcatgaatcccctgacctcaaggacagtttgctgataagcaaactaggagaataaaacgtttatatagaaagaggaaaatccatggcactcatactcctacctccaaccccatgctcatggcagacatcactaatcaatcacagtacttttgatcactgaaacccttatgtggtcttagaatctttaacaggacactccaagaaatcactgctgacagccaactgatttgtgagataaggtctccatgcatctggatcttccatagaactgatagttgcacagcataaaatggtgagggtggggccattgtgggttgagccaccaaggaaggccatccaggcctggatgggccagaacaaaggtacagatgagagaacgcacagggtatcgtgttcaaggtagtgagtaactgaggatagtcaaacggagcagaagaagaaaggggcagcaggaggaagagaatgccagtctcgcacgccctctcccacaggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 380 - DNA, 10119 bp, Homo sapiens; identical to SEQ ID NO: 379
  source 1..10119: mol_type = genomic DNA

SEQ ID NO: 381 - DNA, 103516 bp, Homo sapiens
  source 1..103516: mol_type = genomic DNA
tgacacttattatccttcagtctttattttaaataaggcccctgtcctttaccctcccaaagtacttttagacattttccttctgcccagaatcctctgcccggtcccctgtagctagtgtccagacactggtcacagacctccactgagcccagttagagcgctgacctcccatctcaggacttcttggcccttgcccattgccatactctactgtcagattttaaaactgctagaccatgtgccaattcacattgacttgtagccactaggaccctgtgtctttttctattgtgcttgttcatggccaggaatcaacgaactttggacagacaatcagtagactttgggtgtggccttggtgaaggcttcccactttggtgacttgcatgtgcccctctttgttgagggggttttgaagcagcttctgcgtcattgggagctggctgctgcgcccagcctgaggccctggaccccttttgcaccatcctaatttcaacatccagatgtcaattcagaaaattattatatcattctaatgactcaaaacataaaatcccctcttttgtctcatgttgaagagctgatgacatcggacctatcaggtcagacttattttcctagtcagagactgaatggcatattttcaaagcacttcgtctaaattgcatggcacacaccccaggagcccaaagatctggttgttctcttgagatgcagagaggaggcccacaggtggcggaggggtgaaggaggaggagccaccacttccgaagcatcagaatgtcaaaatctaagttttccacgaggtcagcagcaggtgtctcctggtctggagagggcatggaagtggccacaggtctggacttctctgggtggatgtgagggagggtgattgaactggaggagggggctggcttgagaccttcctgttctatgttgggggggatactgagggtccgtctcactgggacgaagagggggcacagatgcaggtatgcccaggtacctgagtcccagccaaagcggcaaagccagacctcccgggattccttgagtttggacaaagggtgtcccgacgacgataaagagccaggagcagagagccctgcatcttgcctggggccccttgtatctctggctcatggcctgtcctgggcacggggaggaagggagacacccgtaataataacagagaccgcactggactatgggggatcacaatgggtttcagtttgattgagagaaaataaggtaagggacacgtgctcgcctgagtctctggagtaagagtcacgccttggagaaggagggcagccaaaggccacgcagaaattgggggttcaaggtttgcccagccggccccaaaggtgtgggggtccacatggcctcacccaggggccagtggggtggctttgctcatttgagggtgtgcagggtacatatgtgtctgccccgggaatccaagtagccccagtgcgctcctgccttgcttccctagagcgagcccacggtaccatagtcctcgtgggatgaatgcatgaatgatgtggaaggagccagaacagggctgcagacaggatgctctctcatagaaggaccccagagaacttcccctctggagcctgtgcggctggttgagtgtaaacgctgagtcatgctcgctgcccagctgtgtggcaagggcactccctaggcactgagcagccaccgccagccctgagggctgcgggacaacagagagccgggcctgcccgaggcacggcccctgaaaagtgtggcccgccaggtggcacctatgttctcttgcccggcgtgggtgactacacagttgtcatttacgggggaagtagggcacagcagaggtgaacatgaggatgatgctgcgtctgggctgtatccagggaaccagctgccggacaaattggaagggaccttcttggcaggacaggtccagttggtggcctgaggtggggttgtggtgggccttgtccccctgcagggctgacccgtgcaggtgggatcatccttcctgaggagctgccctgcccagtcccgttgccttggaggcggtgacatcaggggcccctgagccaccaggttcctccatcttcatgtggccaccacggctgttgcagagtccacggtaagagccaggacgtggcttccaggcaggatggggaagcacctcccactcccacatggacaaagatttctttaaacggagccaccagccatgcctggtagtgggtgccctccctaggcaggcagtgctggctctgctctttcctgggggaagcccactgctcctcctggggcctagtccgtgggacctgcccagccagccttgggaggggcacccctgggcatgtggagaggaggtgatgaggcgctcagatgtcgaggccaaggccaggtaggtggcaggtgagacaggcccttcagacatgagacccgagtgatgtagataagaggtatgttcccctccagcccccgcccccaggcaaaaggggaaaagacacacagagaacaacagaaaacagttggaaaccccaaagggcgcttgatgaagagctggagctccccgccccccgtgctccgggaggaccaggagacctgctccatgggccaaaccgcctttgcccatccctcccctgacccctgctgcacggttccaagggcttggtagggcagcctgaattttccctaactcccactcctaggaaggtcaaattcaccttgtttgcctccttaaaaattcacaaatgcaggactgaggcttttcctgaaaccagagccccggcagccaaggctcaataaaatactgtttgtgtttccaggcactggggtgggagcgaggctcccagttgctcagagttaaccggccctttcccgagtgagaccccgcgagcactcgtcaattctcccatcaccctccatcgccgcctgctgggggggcctgaggtccggagctgctcttcctcctggcagcccagcctgcaggcctagtgctgtccaaccacagcccagagggcaaggcctcccaaagtgggcgcttgctgagcccctggccagcctcccaggaccctcagtccccacagcccccatccagctctcttttacaccttcccctcccccatctcagaacatgggagaagccgggcacactggcgtctgcaggctgcccttgggctgccacggggccctgtttgcccagcacagagcctgccgtgctttgacccagcaagtcccaccgcaccttccagaggcactgtacagcgtgcatctgttgtcagtacagttttatttgctgtggaatccatgagagccggaagcatcgttggggccgtggctagcagagctcatggtgaccagtcctgggcctgaccaatgggtgattacatttaaaaaccaaaacaaaacaaaacaaaataccaagaacagatcacttgccatggacatcagtaatctattggtaatggtggaaatttcatgaaaatttcccctaaaccataacaaaaactgtcctccttaccccaaaagtgctggaggaaagatggttgcatgacttgacctctctttgaacttgaaatgctaccttcctacccggaaatgcgacacactatacttaaaaggccagatggctgcaggctgtttgcacccctggctctgcccagggacacccctctcctggttctaatgctcagacccaggaggcagagtccgcagcccgagggagcttcaaggccgaggggtaggacctgcagggcccacaccacccttctgatggagagctttgcacatgcattcacacacacatgcctggcgggatcgcagaggatgggtctcgtggcaggagtgggcagaatggggtgcattttacagaagagtcacagagaggctcgccctcggcggaggacacacagctgggtgggcgtgtgggagtgcaggtgtgctgactccgaaccaagggagagctctccgtcctgagctcgctgcccctcacgatgcacacggctgatggctgaggtcagcggtctcttccctgagtggcaggtgtggtccctgggacttcataaaccatcctcatgacagttttacacttagagtccccaatgcactcccaggaggtggcctgggcaggcaggcatcattattctcatgttacaggtgaggaaactgaggctgaaggaggcagaaggccacatacccggggagaatcgcaggcagcaggggccaggccccttccacagcactgcctctcacccttctcccgaccaacccccaagggcatgcctctggcttcatgaaccttcgggggaaattagctttctagtttgggggcggttccctctgactggagacaggacagaatgctttcacacccaggaacggccgtgcagcctggcttagaaacaagggacgaagtggatcctgaggctcattccctggggactccaagaatggggcaggcccagctgcgcagccagtcctggctccactgacttaggctgcacccctgcacatatgtgtgtgtgtgtgtgcatgcgtgcgtgtgtgcatgtgcgtgtgtgtgtgtgtgtgtgtgtgtgtgtgtgcgcattttcccaggggacctctcctccttcctctgaggcaaagtggcctgcaggggcccctgcagagcatacagggaggtgcttccttccctctgcccagcgagcaaagggtggagccttggcacccccagcaaccccctccaagggtggagccttggcacccccagcccccaccccgcaagggaaaggggaagctgcacgaggagcaagatttcattccccagagggcacagcttgggcagattcccatcatctaggggctgtgccccacatctatttctgccaaacaagaagcagacgagggggctcaggggggcgggcctcacaggaacggaagcaccaccccacctctattccctgtggcctccaaaagagctgggcaacctctgccagccactaccccttagcccaaggggagtcctcattccagagccagcatcttcatcttgtcctgatgccctgcccacccccgccgagcttcacactgggctgctatggaaaactgaaaggtcagagggtggaggtcctctccctcctggacatggaaacctccccctgcctggcacttcggctggtcaggaacagtggctgctcatggagctgccctcccaccttcagaccctcctcctcccccgcaggggtgggctggggccctccctccctctgtacttgatccatgacttgtgagttctgagtcctcagggccgagacttgagtcagaaccttctggagcagtacgcatttcccctctgcacctggtgaggacaccaggctcctcgcttcctccccagatctctgagtgctcacccgaccccccaaccctggcgggaccttccagggctggcaagcatcgagcctgaccacgttgcctcttgggtgccagcacgcccacatcaaaggtgtcccctcttcccagaggccctgagcaacatcgggcgacgctgtcagcagacattagcagcagagctgcaccacgcatcaacttttaagtatgcgcacacacgtacgccagccaataacattaagtgtcattttaaaaaatgggttaaataagcagcattgctgaggatggccgtgcagggctgattatcccctatttgcacgttctggcggtgggaaggctagaagtctaatgactgaattatcgccctaatgcctctcgctggctgggaataatcccggggcaacagctgccgcggggtttttggctggtttcctctaattgcatccagattaagggagttgtggaggggcggggcttctccatcccccgcggagcagcgtctcctccgccaagccctgaacacccagctcatggcttccgaggtcctggctggtccgagaggtgcagacctcactggggtccgggccagcccatggggagcgtgaggtgcgagcagtgcacggtgggggtggcacttggtgcagagatgcagctgattggtccgggtcaggtcttggggagcagcaggggtgagaagctgtagggccaggagactcagaaggaatgccttctactaggaccttcccaagtgaggggagccctggacctgtctatcctcttcctccctcccaaacacagcggttcaaaggcacgaggtatctagtgaaatgctaggaccagggacgctattcccctggagcaggcgggtggggaaggagtgctccaaagcaggcattattaggacacagactctccagagtcccagttgtttagccctccaaattctcagcctactgccacccgactgtgcagagcggacaataaagtggcaggcctgtcccccaccccttaatgctgagcccagccacgtgacttgctgtggccaaggggagagctgcaggtgtggtgtccaccaaggcttggaaaggcacttgctgtctctccctccgtgcctttggctgtgccatggctggcctgcaggagggatgcaagagaccacagagcagggccaggtccgacctctgcaccatgagcatcccctgggacttaacaacccactggccctaaacaaacaagcccagcctagaccagaagaatcaccctgcccagactgctgactcctgccctagatcagtgctgactgttgcaggccaccgagtgttggcggatttgttacacagtattgctgtggcaatggatataactggtttctagcggagggtcagggcagaagctccagccacctccctagcccagaaaggcaaccctctcttcccagaagcaacatggatgagaagcccaccccattcccaccacaggatcccccactgctagacagcaatggtcggtaccccaggatctgggcactgatggggctccaggacggtctcctcaaaaggctcttaggcagacagacctgggaacttggaagtacctgctggacgacctgggttcatggagaaaagagaagccgagaaggtggaggaggccggtaagtggtgacctccgctttcctgctgaggaacactgctttgaagtggcatggcccagcagtgcccaccctccagggagaaaagctttgagtgggaagaagccttctatcctggtccccatgatggttctcagcacatcaagggtttttctccccagaaggacgcgatggaggatttcaggagggatttggtctcctcgctcaaggagtggctttctgtgcaaatggctcgacacttctaagctggctgggagttctcacagcatagatcgcacacccttttctgtccatctctaaatcccagaaggagcaactgatacacaatcttttggaagagggagagtctgttgggaagacctcattcccacatagaaggcagagagccctgagtgctggctccttcactgtggtcgctctcacgtccgaccacctgagaagctgacttacatatctgagttcacaggtcctgaagggaagtggaagagtctaactatttccaggtgtccttgtcttggttggtcagctaatacactaccacgtccctgggacaaagcagatcattgtcagaggatcttgcaaacacaaacacgcacgcacgtgtgcatgcatgcatgcacgcagggacacacgcacacatcgacccattcaagccccagctggttgctgtatttggtggagttgaccttaaacaacgccaaggaacctcacgtagaagacccccagcaaagaaaaaggcatcagatgcttctccaacagcctgaggctcaggctcctgggcagacagttcccttcgtgtaccaggaggacgaaatgtttaaacggataaacattacaagcgccagctcctcaagcctgactgctcttccgcctctctatccccacatcggttgggctttttatcttttgcttttcttttatggcagatgcctttccatcggcatcccagctgtggctggggacgttttgggaagtgtgtttggctcactccgagagaacgaggtctcaagaggaagtgtgtctggcttgcaaagatgtccctgggcctggacaggaccccgctgtgttctgcagccctcgacgcagtgggtgagtgaggccttcctctcctgtctctgctttcctcattgcctggcgacgctgtctggctgccctcgagggtggagcaaatcctgggacatgttgaaatcctccagggcagccagcaggagagcccagccagcctgcgtctcaggtgcggtggctgcgcgttccactgcagcgtttcaggagctgactttcctctgggtggctgtagatctgacttctgtcacttccagactctaattttgtcattaatatgaaaaggttcctctcatgttgcccaaaagcattttccttaggtttctaccgtcccctgtccccttcacgcccagccccaccccctcccgtgcccagggcctctgaggaggtcccctcaacccctgtccggtgtcgggggcccgacctatctgcggaagccgaagccgtcctgcggcgtctttgggcccttcttgccttccctcagggacttgggggaaggcatctccaccgtgcccccgtagggacagctctccgagccgggatggtggccggtgcactccaccgcgggcatggagccgctgtcccacatgcctgacccgcacagcttacacagatcgtgcaggctgcaggggatccggggcaggaggcggaactggtacagcaaactcctcgcctgcagacagaggacggggggtgaggaggggccgggggacagcctggcagcctagggtccccatgggagtggccaaagacagcaacagcagcaacaacggcctgcacctcgggggctcaccgagtcctggactgagggctctgcctgcatctcccaccatcaccggcaccacggggccctgggtcttaggtggctgcagtgatgggacccacaaggcactcgggctgtgctcacaggtggctcgaggtgaacaaggcccttgaatgggcttcattcaggagggtgaacaggaccaacaccagcacagggccgggtggcgtccagccaagcccacctgtccctttggcagcacccctctcttcttcccccgcaccttgctccaccccccacccccagcagcctctcagctcctgcaggatctgtgtcctgtgccagaggacaccaccgacctcgggacccccgctcagtgccctgaggaccaccagagagctaacgggcagcatctccaggaggcgtctgggaagtgggggagggggccaaagcccaaggtccccagtattctggccaccctgtccccaggtccagcctccttctcagtgttcccagttctgggttgtaagcgaggtaccccagggtagggaacctgtcctgtccgtcagccccggtgaattcgttccctcctcagccagcgagggaggctcctgtgtcagggctggcaccccaggaaagtgaggtgacacagccaggccgagacaggtgctgaccacgaggccttagtggggagcccccagtgctatgggtgggggagggcacgtgctggggggccatggtggggatggggctctgggggcggggcccacatctggggcagcctcacctttctgagaacgagctggtggggtggggctttgggggcggggcggggtggggcccacatctggggcagcctcaccttccggagaacgagctccccgttcatgtgcatggccaggtttccgaagtgcaggagcatctggtccgtggccagctgctgctcgatgacgtcatccccgtagatggccacgatggccacgcagatgaaaaggtggaagtagtccgtctgtggaggcgggtagagttcagacacgggctctgaccgagccccaggccctgcactcagggggaaactgagtgccagggtgcgagtgagggctccagggcgaggggtctgggctcacagcccagctcgggggccgtgtggccctgggcaagctgcaccgcctcttcggccctaagtttccccacctgcacatggggtctgtcccagtacccgcatgcccaggctgctgtgacatccagaggggacgatgctgagctcagcccccacgggctgctgctgctctcctgggtggtgatgtgggtggtctccatgacagggtgggggtgggggggtacaaagagcacccttcctcagaaggcctggcctgtgctcatggggaggactcatttgtaatggtcctgagcaacggtgtgtgcggaagtctgggtcagaactcactccagcgggtcatggaatgcgcctctggcagccacccacgggtcagcctgtcctcctggctccaggccacaccccccaatcatgccccagagatgactctagggtttgtggctagaaaagtgggaagatcctaacagagcgggcacagcagctcacccacagggtggctgaaatgatcgccctgtccttgagcctcttttcgggcatactttgaggactccgcagccctccctttaaagaccgcctcacggggcctgccagcaacgcgctgtgtgcagcaggaagcccacgccaggtcctgacggctgcatcctgtgtgctctccggcctggccgcctcaagacacgccacctttgatgcacacgcgcttccggaggcacaggaaggacgggggcactgggaagtccatgtttagtctcctgacgtcgaccacacaaaccagacggaacggtgtccccggcccaggctgagcggagcacaccatgagggcagaggctacaggtgactcccacgccccagcctgctcctggagagaccatgcaccaggctgcccggctgcttcctctgaactaatctgggacggtcttgttttggctctgacggatccttttgcagtgatttgaactgtggctggtgcgagacacagcggaggggttgcaggaaggtggacgcccagcttctctgggagaggaatgtggggagggagagggagggcacgatctccacagcctgcacagcataggcagatttcagttcccaggacaggcagggcgtagggccgtccagccccaccacatgctgacagcggacggatagcatcaaaagcctttctcgctcaggggtcactgaacagttaaaggcctcacctggcagcaaccttcccattccacagagctcactctcagctcatcagcagcccacccccacccccaccccgtaatactaccaaattgatcgagggatgggaccgaccgtggctaaatcaagcccacagtctgaaaacaacagaaacttgctttgtggacttccaacacaatggcagccaacagagatcccacgtcacgtgggcctcccgctggaattctgactagatctcattacacttgggacacagtaggtgtccatgggaaagggacccatctgccgggccacgcgctgagttcacgggtaacatcagcctgaacgtaaaggaatgagggcggcaaatctgccactgggaaaacgtgcaatgaggcacgattttttttaattcgggagtggtgggaatgaagcctctcagaccgtccatgccgtgcttcccttcgttaatgcagatcgtccaccctgcacgtccacgtccagcaggctgagccaggagggaaacctagacccgggccaggggcgagccgatgaccgcatgcaaaggcggcgtgtggtaccggcactcggtggcttcagactcgctttcatcagacatcagccccctgcggtgtgagtgaggacaggagacgctgacgcaaatgtcttccagcagatgggtgtttgcctccatcttcagggttctctgacggaggctgctggagctgccgtggtggatagagccagctcctgcaaaagggtccagccctcctggatgcgtcgatgtgagttttttttttaaaaggctgatggactcaaagagacttgcttatcttttgacatctccagcttgtccctagtttgggcgttaaggccatgtgacagagccagtgctgtgctccaaggggaatttgctgagaagatgctggtgacggtggacggagagtggaagtcggtatcactgattggggccctctggaggggccgacagggaagtgggatctcaggccctttctctgcacagcagggtaacgggtgagtcggccctcgtggcagggcggtcccgagggggtggagcggtgctggctcacgctcgtgggcaccagcgtcctgggctgctgtggcctagtgtaggccccccacagtgtcactcacactgattggttgtgacaggagggagctcagccccagaaagtggtaatgagtgcagtcagcgggcaatttgcatcgatttcagtgactggggaggcgagctgtaaggtctgaagccagccacgtgggacgggaaggcagtcgccgtatggggggctaatgtgtggctgtgggtggggggcggcgaggcggacaggggcagcaggcagggtggccacggtggttcaggggccatggtcccaacctccccagccctggcccctgccctggtcacctggtagtgggcccagcaggcctcccagatccgcagcgcttcggcctcggggaactcccgcttgaagcacagaaggagccagcggtggcagaagagcatctgcaggccgtcctcgcccagcgagaccaggtgctggtagaagcgcacgtgcgtcagccgcagcagctcgcgcaggtacagctgggggtgaggccgtcacgcgttagttagctccggtcccatgcggcctgctgcccaggaagcccactcccactggggcccttccctgggccaccccagcctggaaaagcacacccaggggcctctacctgctgcatgtgcctgcccccccaacgctccattccgccgctggaatcggctcacacctgcctctgccagttcctcccagatctgactgttccggaggctgtggtgtggtccagggtgaggcagagtgttgtgcccgggcgtggcaggacgctggcagccgctccatggccaggaaggctccccaccctcagtgcacacttgggggctgtttcccacgtccactcctcctggtgaggtgagtggatcatccagggagcccccccacccctcttcggctacgctcacccagatctatcatcttccagagctgttttagggcaggaaggggacgtatctgagccccaggatgctcgattcctgccattaaggtcatctcccaatgatgtgggacaagatcggggctatttctggcagcactcgggcccaggccgctgacttcatcaatgccgctggaaaatcaatctccagcattcagtgagtcacccagccatgcgctgccatgagccgtcagaggcgaatggcgttggacactgtaactgcctccccaagcaatgtggacacccgacgtcacacacacccgttgatgcagagtgagcaggcttggctgggttcagccccccggcccaggtggagttagatcacagctggggggatcctggggcagagctcggggccacatgcccccttcccacacaggtggcccattgttcccacgggagactgcgctgaagctgtgcggccagccctccgccctgtggcctacggccaggtcaagcccactcgtgtggctgacccccttgcagatgctccactcccgccccctgtgcaggtgcctgcacctccctgcttgggctcctttgccttcaaatcctctctgttggcatcagctctcccagcctgtcatcagcgacccactaacagtcagtctatagcagcggtccccaacctttttggcactagggacccgtttcctggaagacaatttttccacggacaaggtagtgcgaatggtttcaggttgaaactgttccccctcacatcatcaggcattagattctcataagcagtacacaacctagacccctcacatgctcagttcacagtagggttctcgcgttcgagcttctgtgagaatctaatgcagccgctgatctgacggcaggtggagctcaggcgggaatgctcgctggcccgtccaccgctcacctcctgcggtgcggccagttcctaacaggccatggaccagtaccagtcctgggcctgggagtggggatcccattctatgagacacactccgtggcctggggctggggaaccccgttctacaagtcacactctgtgtcctggggtggggaccccattctacaagtcacactctgtgtcctggggtggggaccccattctgagacacgctctgtgtcctgggggtggggacccccgttctatgagacacactctgtggccctggccttcaaggccctccatcagctccaccctcactacttgtgacgggtctggtccaggaagaccaggtcactcagtcccaccactgggactgctctgctcagcccagccttagcgacactcagggccagaccccacacaccctggagctgtccccggtgcaggagccctcttgtccttatcacgggcacctcccacagtgctccccgacacccagcgtcctctgctcacaatgccagcttcctggcccagccaggagggtgaatgtctggtgactgcacccggcaggcacttggttgacatgggtgatgtgtgctgagaacagtgagcaggtgccctggctcagccctggttcggtcccacacgctggccctccggcgctgccttacccagctgggctcagccccaccaccgacattcagtgcttcctggtctacatagggctggtccttttgaggaggccttgacgggagaggtgtcagcagggcaccccaggggaggggtggggtgtgaggactgccccagagacctcagggggtttcaggagcccctcctcttcctgtctgcactcagaagccctggctgtgttgactcctgcagggagcagcttagacacacctgaggacccattttctaaggctcagagggggctgggtgtgatggtgccacgtcttccttgccagccagggagcttgggccaggttgtcacgtgcaggggtggaaggccaccagagcggcccacacaacgcggcctctggacctgcagggagtcagagggccatccccggaggccgagataggctaagccgcccatatcccacgggcaagtcctatcctggcgttcccactgcccactgacctacagcagccaagccacgcatcaccacggcaaccccggctacaacgggagaggcaacacgggccctcacatgcccttggacgcacccatccccctgagcctcaccagttgtttctccatgtcctcgtcccggggtgagctgacgaagatcgtgttctgcatcaaacccacaaagcaccagaaggtgtctgactcatccaggacctcggccaagatgggcgccaccaggtccgacatcccttgggaatagccgacggcagggttgtacacggcgtagttcagcaggatcctcctgggaggcggtggagacagcagtgggtggggatgaccctcaccgcggcacactgcccagcctgcagaaccctgggccgtggaccctgccttccctcgcttgccttcacctcagtggaaggcagctgtgccaccatctcagagcccaagcttagcttccagacacacagacccttgctttgcaaaaggtaatggcctggccgggcgcggtggcccacgcctacaatcccagcactttgggaggctgaggtgggcagatcacctgaggtcaggagttcgacactagcctggccaacatggtgaaaccctgtctctactaaaaatacaaaacttagccgggcatggtggggtgcacgcctgtaatctcagctacttgggaggctgagactggagaatcgcttgaacccggaaagcggaagttgcagtgagccgagatcacaccactgcactccagtctggatgacagagcgagactccgtctcaaaaaaaaaaaaaaaagtaatggcctgctattagctgctgtctaggcccagaatcttgagagcaggggttaagggggaacatggctctgattttctgaagggtggactgcctgtgacaaggggtgggctggcagggacatttctgtgggctgctaattttgtgcaattatttgctaggctgtagcagaatgtcacagatgccagcctctggctctgtgtggctgtatgactacgggaccacccacggggagatggagggggtgcatggggaagctggtccatggttagtgtgagccaagcaaggacaggcttggtggtgcccaggggatagaggggctctgtgggcagggacctgggtggcttccctgggatgccatggctctgagatgccaactgacgtagctcatgagtagcgtatccttcacttctggggctttgatgtatgaacctggaagagagcccctgcagaaactcgctgggggctcatccacttcccagagcggtcaggtgaggcttgcagacttgcagatgggaaaggagctggctggggagggagtacctcatgctctccacattgggattgtcttccccccggaagaactggttgttccgatctgtccggaccacgtctttgtccacagtgaactgcacattacgccagaacgctctgtgctcctcgggagtcatggagagcctgtgtggagccgagcacccagccggggtcagcgggtggcacccagaggcatcgtgtggcgcacacactgcaggaagccacccttcctcccaacccccgttccctggacgggagctgggcggctgctgccggctgcagaccctccccggatgcggcggatgggtggcgtgtatccaaggctctccttgatattaactcagcctcacagtctccagcgtcccaggaaggagagcaagttgcagcccagtgggtaatgaggccttggccctggcccagcgttctggaggggagctgagcacagcccaggggcttcacccagtcccagcctcctggagagagagctgagcccagtcccgggttagcagatcccaagtgggacacagtctccggatgccttcacccctccaggccctgctcccagccccagccttcagctgtgggacgtcagcgcctagttaagtctgttgaacgagaattctaaaaccttgacatgtgagctaacgagccccgcagctccgaggcccgagtgcttggtttaatgactgcacttatcccaccctatcactcacgttcctgggagacccatttttgaaagaaactatgggtcacgaaacatattatcaatgctgaattgcacctcaaattgccttttcaaatgacattttcctccgcggctcggcggggtgggccgggctggccccggcggttaccttttctgctggatctcagagtactcctttcgcttctgcagccgcagcgcctcccgctcctccgacgtggactcgtggctgtaatagcgcagcaggaagggccagacctccccgcggattgacacatcaataccgccaaagaaaatggcctggaggaagcggcaaaagttggggaggggataaaatggggcagctcaaagaacccccaaatccccagagatgtgtgttttggtggtttttggtgcgccttgattcagatctctgcaatttgcacatatttacaaggggaaagcagtggccttcaattcccatacaggacacaaacccggctcatttcaatgtcaatgccccccctggggtggcgctcagattaacgtgtcgttctcacgtcatggcctaatccctggttttggaaatgctgcatttcactgcaaacccttctatgcaggctgacacggtatccccccaaaccctcgagggaggtgttgtgttttgtttttttttttcaacgcagcagctttgattgctttatcggtgtgttcacagagagcctcacacaagaaaacggggccctcacgaggaggtggcccgtgggtgcgggcgggcggccaggccccggccctccttccctctcgctcgttcccggttcccggccggctctccgcggggccagctgggcggacccggacctcaccttccgcagcttgtactcctcctccacctggcccagctcattcaggtggttgagccaggcggagacgccgagcctcttgtacatgctctcctcggggtgcgtctcggaggacggcagcttggggcggcggatggagaactgcatgcatgtcttatcgggggcgacctgctggacgggaggaaaactgggcaaaggtcaggatctcagccgcgcggcttcagaggccagcagtgcttttcccaggaataaaagcctctctctcttctgaaaggagggcaagggccgtcccctgcatacaaacccctaaatggcgagtgtaattaggcgcaattaaaatgaaaataccttcatcttaaaatcggtttccctctgcggctctctcctccccggcccactgtgccgccgccccccactctctccaaccccagccgcaaaaacggaatgaatgcctcgttcggcctaacttccctctgccgggagggcctgcaatgaattacatgtgattggccacatacaaagggatcgctgttctgcgagcagggagccagcctgtcagattgcctccgcgagcagtcacgaatccagggcaaaactgcagctgacatttaattcaaaaatcaaaggttgttcaatgtagggggaaaaaaagccatgctactgtaataagggaagccagcaggaggctctgcgggaaggaagggaattttaaaatcggccccatttctaataagcacatacagtaccttaaacagataattaaagagctcttattacatttgtacgtagattgagcaaaatatggcaggaagtcttgtcaaaacatgatttttcaagtgcagggcactgactttaccgaaagccctgggcaaaggtttcaaacccaaagttgctgctctgacggccaaaaactaccgtgggtcacaccccgtaagcccccggggcccggggaccccagacacaggacccaggagggagatggggcccgtggggggtggggagtgtcaaccgctgggcattctggggccgtctgctgggctacctggtctttgagctgcatctcggtgcagtatttccactgctggaacacgtcagacagcttgtccaggccgccgtggtggaagtggaaaaccttgtactggctctctcggctggcaacgaccagctggccgctggtgcaggcctcgtcgctgaagggccattggaagggggagagggaagcccgatgaatatgtaaacacgggggttttatttccaagtataatcagaggccactgtcgccaacctcagaagcaggaaacagtgagtcccagtggagttggctgctagcgggaggggacagaactacaccgaacaaaaaccaccaccccctttgccgaagatggcaaaactgctccttcctggggggccctggagctcctctctggagacctgccagagtggccttctccccaccaccccctgcccggcaacatggtccctgcagtccgggagacctgggtcccaacgctgagtgccctggaatccagttctgagccctggcaggccatgtgctaagagaacctcctgggaacagacctccttcgttgcgtgtgggtggaactctgggagaaccctccagggaaactcagtaaacatccgtcagtgctgtcagcccagccccggctgcccttagatgaaaggctggaatgtggctctgggtctgggaacccccccagcttctggacacgccggcttcttctaagcccgggcctctcattggtgatgtctgcggctgggcagccctgactataaggaggaggatctggtgtggggaatgactgcaggaaactaggcatcgcccacccatcacgaaaggaagggagcctccatccggaaagctgcggcccgtcccgcacaggtggccgagctccagagcatcccccggcgatcagagccgccggcagctgctaccctctgccctggtttggtttcttctcccaagccagagttgcaagcaaccgctggctaccatcacgctgaaggtaggggagtgagttcggtagctcacccagcctgagaactgtcagggagctgcagtggggaatcactgcccacaagatcagcgagggaggaaagcagacgcttgggaagactccatccagggccctgtgtccccaagccgtgcactgcaccggctgcaaagcccaggctgccagggaaaacacacacaggccaactcccaggaggcgcccagagatgcttcctacctgaagaaaaggcggagggagcgcatgtggcccaggtccacgcggaacacgccgcaaatctgctccagggcgcacacccgctgcggctcgtcccagcgtggggtctgcaggaggccgttgctgtccgggaaccgcaggccggcgtcggagctggacggggggctggtggaacaggttatgtgatgatcgccacacttctccctgcccacactacccagagggggacgggggtcatgggggagtcatttaaacctacgcaccaagcttaaacacacatacaggcacggctgaatatgccctgtaaacacctgtgaataaatgaatgtatgaaccccactgcacagttctacttccacttggatgggaaagcattttcatgatcaaattccattccacttcaatagaggcagtaagtcatcatcgtcctgacagccaaggtcacactgactggggttcctcgctgtgtgaccttggccaagccaccaagcctctctcagccttcgttttcccatggataaagaaggcaggagaataacaaggctgggtttccctacagcgtggggctgggctttactaaaactggttgttttgggatgattttagatagcatggggcttccgcgtggtttaaaccagctcactgtattcctgaaaagtactggttcagtttatgcttttggttaggaaacatttgggttctcagtactattaataacatcatcagcatttattaaaacactgactatgggcctggccctgagctaatgcttctcaggtgcttttattgcaattaatcttcacaaaaatcctctgaaatgaatagtggtattaccccattgtaaagaagaggcaactggggcccagagaggttaagtaatttgcccaaggtcacacagctggcaagtggtagagctgagattagaacccaagctttgtggcccatgttctcaccagcatactgtgcagctgtctgcagttcagcagtacaaccccatttattctgttattttttatgagtttgttacattccaaattgcaaaatatcttattatatggattcagccacctcacaggttaaatcttgtctcttgagattttttctttttttcttttttcttttttttttctttttttgagacggagtctcgctctgtcacccaggctggagtgcagtgtgcgatctcggctcactgccacttctgccttccgggttcaagcgattctcctgcctcagcctcctgagtagctgagattacagacgtccaccaccatgaccagctaattctatatatttagtagagacgaggtttcaccatgttgaccaggctagtcttgacctcctgacctcaggtgatccacccgcctcagcctccaaaagtgttgggattacaggcgtgagccatcgcgcctgacactctcttgagatttaatgtctagcaaatgtctgctaaaataaaaccggagtacaggcaagactcagctctggaccccaactgcagcaccccacagagactcagccgcattcaccgcacctgccttcccgtttgagctcagaacataaactattagaggcaatcaatccagaggcacttcctcctccaagaagcaccaggtctaagtaaataaagctcctttggagggttccagcacaatccctccccactgggaacttcacacagagaaacctgactggcctttctagagccctctactgcgtcaggcatagccctgggcctggtgagtggcaggtggcctttcttccccacctgcctaaggaagtcagccgaacaggtcctcccactgctggggcccctgggctctcaaggaaactgagtcaggtaaaactagatcagagatgggcatgtggggccatcacctgaactgccgtggctgcgccgcggacgggcccagaagaccgagggctcctgacatcttcccaagtggaccctgcgggagctgcgcttcagaatcgttgctcacaacacagggcaggtctcgagtctgaggccccaccgcacccatgggtgcccccttctgtcatctgctcattgaaccgcggggctgctgtgactgtgagagctgctgccccgtgtgctgcctgctggcccggcccacccagtggggccatcagagggtggtatcctttcccgcctcctcccccagccttcttaccacacccaacagcagaatcccccaaacctgcttgttcctcccagcacactgtggcccactcaccctacagggcaggccaaggtttccagaaaccagacagaacacagagactcgctttggcagtcacggatggagggccccctccctgctgccgtggccacagaagactggtcccctggagggccggagccgatttcaaaccaggcaagagtccaggacacaggggccaccacacacctcccccagcaacgtgcctccaggcaggagttggcttaaaccctctcgcaaccccttaggggcaaattatttgcattaattaatggattgattcattaattcaagatactgtgcttgggacctacagctggggttccataagctcaaactagagcgaaggtgatggagacctcagttcgctttcattggggtacgtctggcaggtaccccaggccctgtgtggtcatggaggacgaggtctggtgcccctcgaggccggctgctgtggggtgggggttgcatcgtgtctcttcatcttcagctcccagccctggcttggcgcagaacacacagacatttaatactcatgcctgaagtgaaaatgtaaagtgtctgggaattttgaagtcacagaaaaaaatgtttaaagaaaataaactacagggaaaacgaaatatgtacagtgttttatttttgcttatctttctacacacgtaaagcaatttagttttaagaatattcatatatgctgcaaataatttagcttgttcataaaattatgtgatgcattggaactaaaaggatgggttttgcaggcgataactcccaagatgctattacattagaaagatctcacacataaaactagaagacgctaaactttaagaaatgtagcagttcttcatttctatcattttctgaagatcacccaaatgtaaaagcagtaatgaaaaaaagtcagcactatcactggaaaacaaacacaaacactgggttctccctccaccacagtaaactatgccatgtcagatacagagatagagatttaaaagggcctcaaattcttcacagctcatcttatcaaggatagcacctgtctctccacccctgaatctaggtgggccttttttgaccaatagaatgtggcaaacatggtgttaggtgagttctggggcctaggcagcccctcactcttcctcttggcacagtgcaggcaagacagacagacgagagctcatgagagagacacgcaactggcagtcagcaccagagccccgacacctgtcaatggaggccgttccagaccctccgcccacccaagcctcctggtggctgcagcgacctgagtgaactccagggagcccagcgcaacagcctgtcccagcccagcccaaaccaaaggtctgtgagcaaagaagcggttttttgtttgtttgtttgttttttaaagacaaggtctccctctatccccctggctgaagtgcggtggtgcaaacacaactcaccgcagcctcagcctccggggctcaagcgatcctccagcctcagtctcccaagtagctgggactacaggcactcaccaccacatttggctaatttttgtattttttatagagatggggttttgccatgttgcccaggctggtctcaaactcctgagctcaagcgatctgtctgccttggcctcccaaagtgctgggactacaggcgtgagccaccacgctgggcccggtggtcgctttaagttgctgagtttgagggcggtttgtttcacagcaacggatcactgacacacgcaggacaagccagctctcagaaaaagcttgaaggggaggaagaaaccttcaaacatattgagctgtggttctcaaggttaccagggccagattttagcattatttaaaatacctaaactgctaaatttcctcttgcttttcttcatcctgagccttttaagtttgctgaaaaaagtcgatgagaacccagctgtaggtcccaagcacagtgtcctgaattaatgaatcaatccattaattaatgcaaataatttgcccctaaggggttgtgagagggtttaagccaacttctgcctggaggcacgttgctgggggaggtgtgcggtggctcctgggtccaggactcttgcctagatagaaactggcactggccctccaggggaccagtcttctgtggccacagcagcagggagggggccctccacccgtgactgccaaagcgagtctctgtgttctgtctggtttctggaaaccttgccctgccctgtagggtgggtgggacacagtatgctgggagggatgtgtaggtattggaggagtgagcagggcgtgttcggtgtgctgggttgggagaggaggctgtgatgggagaggaggctggaaagaatgacaccctttggtggtcccccataattgccaaaacctggaagccaccaagatgtcctttggtagtgaatggataaataagtttaaataactgtggtgcagccagacaagggaatatattactcatcattaaaaagaaatgagctgtcgagctgtggaacaacacggagggaacttcagtgcgtcttacgaaggggtttactaagtgaagggacccactgtgacaaggctgcaccctgtgggattccaattctaggacactctggaaaaggcaaaaccatggagacagtgacaagaccagtggttgccaggagctggcggggaggtaggaaggtgaagcacggagaacttttagggcagtgacacaccggcatgacaccagagtggtcacggtgacaggtgtctttatacatttgtccagacccataggatgtacaagaccgagtgtgaatgccgacaaactatagactctgggtgacaatgacgtgtgggctcatgagtcgtaacatgtgtcccactctggtgggggaggctgtgcgtgtggtgggggagggggtggatgagaattctctgtacccttcactcagttttgctgtgaaactaaaacagcttcaaaaaataacatctattaaaaaaaaaaaaccaacaaaacaaatgaatagccaaagaaactgggacacatatatgataaagattaacatctttagtatgtaaaaaagtatgtaaattaaaaagaaaaatataaatgcccaacagaaaactggcaaaaggaaaataaaaaaatttagtagagaataaatacaaataatgaataaaatttccaggcccagggtaatgaaataaatggaaatagaaacgggataacatggtggggggatggtttatgaaattggcatcaattaacaaattataaaatctagtgtggtaaaggatttggggaaacagacattctcattcagctcagggggagaaagaatataaactgaccaattttttttttttttttttgagatggagttttttgctcttgttgcccaggctgaaatgcaatggcaagatctcggctcactgcaacctccacctcccgggttcaagcgattctcctgcctcagcctcccgagtagctgggattacaggcgcctgccaccatgcctggctaatttttgtatttttagtagagatggggtttcgccatgttggccagtctcgtctggaactcctgacctcgtgatccgcctgcctcagtctcccaaagtgctgggatcacaggcgtgagccaccgcgcccagccctgaccaaatatttctgaatggcaatttggaaacaagatgccaaaggcttaaaaatgtttatacattttgacttttcacttccattcctaggaatgaatcctaaggacatagccagaggtgcccacaataaaggcatacatgcacagatgcagaaaagcattcgacaaaaatccaatgctcatttatgacaaacctgtctacaaactaggaatggaagagaagctcctcaagctgataaaggcacccacagatattccaccgttagcgtcatactgaatggtaaaagatggaattgttttcccccaagagcaggaacaaggtaagaatgcctctgctcccaccacttctagtccatgctctcacagaggccctggcctctgcatcaggcaagaaaaggaaataaaaggcataaagactggaaaagaaggaacagaactgcccctattttcagttgatacaactgttcatctgaaaaacctcatggaatttataaaacaatctttagaactaataactggatttcataaaactgcaggataaaaggttaatagagaaaaattaattgtattcttaaacagtaacaatgcacaattggaacatgaaataaataaaacattaaatttatagtagcaaaaaaatccccacataaaatacttcggaataagcctgacaaaagacattcaagaacgtcatactgaaaaacacaaaaattgctgagataagtcaaataggatcttaagaaatgcagaaatgcaccatgtccatagaataaaaccgtcaacttggttaagatgacaatcttgccaaactgatctacagattcaacacaagcccaatcaaaattccaacaggaatttttagtgaaaattgataagttgaccctaaaatttggagctagtataaccagagcgactataaaaaagaagaacaaagttggaggatgcatctgactttgagacctacatagctatcatcaagaaagtttggtattggtgaaaagataactatggtgaaataggcaaataatcaatggaacataacagagtccaaaaatatcaattgattatttacaaaagtgcaaagacaattcagtggagaaaggatggcttttcaataaacgatactggatcaacaggatatctgcatgaaaaaaattaacatcaactcttttctcccatcactcccccaaattaactcaaaacggatcacggacctagatgtgaaaccttaactaggaaacttccagaagaatccgtaagagaaaacctgtgtaaccttagaataggcccaggtttcttagatagaacacaaaaaatacaaactgtaaaagaaataataaattggaaaattaaagacttttttttttcatcaaaatactccattaaaggaaacaaaaatgcaagtcacagactgggagaaaatattcacaaaacatatagtcaacaaaaaacttgtatccagagtatgtataagaaactgttaaaatgaaatactattgttacacaaaggtttcttagaccagacaccaacatatgaccataagtgaaaaaaaaaattaatcttcattaaaatgaaaaccttctactctttaagagatattgttaagaaaataaaaagataagccacagactgggaaaaagatatttgccaaatgcttatatgataaagggcttatcatataagtcagtaatatgctttaaatcatcattctatacagaatatagaaaaggtcctcaaaacagtaataagaaaacacaatccaaacatgggcaaaagatttgaaaagacatttcaccaaagaggatattcagatggccaagaagcctatgaaaaggtgctcgacagcattcattattagagaaatgcaaatagaaagaaacctcaatgcaatctaaaggaacatgatgtgatccactacacatctattggaatgactaaaaaacaaatgaatgaggccacgagcaaggcagttcaagcttgtaatcccagcattttgggaagctgaggcgggtgggtcacctgagctcaggagttcaagactagcctgggcaacatggcgaaatcccgtttctgctaaaaatacaaaaaattagtaggcatcgcagtgcacctctgttatcccagctactccagaggctgaggcaggagaatcacttgaaccctggaggcgaggttgcagtgagccaacatcatgccactgcacttcagcccgagcgacagagtgagactctgtctcaaaaaaacccaaaaaacaaaaacccaaaaaaaaaaaaaaaaaaaaaaaaaaaaaacgaaggaatgaaactgacactgtgagtgctggccaggaggcgagcaacagaactctcctacaatgtgacgggaagtcaaatgacagaaccactctggagaactgtttggcagtgtcttataaagtcacacacacccctaccatatgactcagcaatgccccctaggtatttacccaaaatacatggaaaatgttcacacgaaatctgtgtgtgaatgtttatagcagttttattcatcattgcagaaaacaggaaatgacacaaacgtctttcagctggtgaatggctaaacaaacaatggtacatcttaacaagggaatacatacgcctcagcaataaaaaggagcaaactgctgatatgcatgacgatatggaagcatctcagttgtattatgttaagtgaaagaagccagacacaaaaggctacatgagaagatactcagcatcctctgtagtcaggaaaatgcaaattaaaaccacaatgagatactcctactcacctattagaatggctacagtggacaagactgatcatagcaagtgttgctgaggacatggaggaactggaactctcacggactgctggtgggaatgcaacacggcaaaccactttaggaaagcagttcagtaatttcttaaaaattaaacacatgcctgtttccagttattccattcccaagtatttaccaagagaaataaaaacatatgtccacgtgcaaagacttgcacataaatgtgtgtaacagctttatctaaaatagctaagaactggccaggcacagtggctcacgcctataatcccagcactttgggaggccgaggctggtggatcacctgaggtcaggagtttgagaccagtgtgaccaacatggtgaaacactgtatctaccaaaaatacaaaaaatcagccagacgtggtggcgggcgcctataatcccagctactcgggaggctcaggcaggagacttgcttgaaccctggaggcagaggttgcagtgagccaagatcacgagactgcgctccagcctaggcaagaagagcaaaactccatctcaaaaaaataaaaataaaaataataaaataaaatagataagaactgaaaacaacccagggtttatcaacagccaatgcagtaatgaatcgtggtctgtacataccatggcatactactcagctgtaacacgcagtagcatggacgcatgacaaaattattatgctgattgaaagaagcaggacaaaaaacaagcacatactgcatgatcccatttacataaaattctagaaaaggcaaacaaatctagagtgatgcaaagcagatgcaacttttttcctttttccaattattttattgtgttaaaaaatacttatcatcaaatttaccatctcaacctattttttttttttttttttttttttttttgagacagagtcatctcactctgttggccaggctacagtgcagtggcaagatcttggctcactgcaacctccacctcccggactcaagcaattctcctgcctcagcctcccaagtatctgggattacaggtacccgccaccacgcctggctaatttttgtatttttagtagagatggggtttcaccatgttggccagctggcctcaaactcctgacctcaggtgatccgcccaccttgcctcccaaagtgctgggattacaggtgtgacccaccacacccggccccatctcaaccatttttaaatgtacagttcaggtattaaatatatttctaatattgtacaatgatcatcaccttccatttccagaactcttttcatcttgtaaaacaaaagctctatacctattaaacaatagcttccaggccaggcgcggtggctcatgcctgtaattccagcactttgggaggctgaggtgggcaggtcacttgaggtcaggagtttgtgaccagcctgaccaacatgatgaaatcccatctctactaaaaatacaaaaattaatggtggctcatgcctgtaaccccagcactttgggaggccgaggtgggcggatcacctgaggtcaggagttcgagaccagcctgaccaatatgatgaaaccccatctctactaaaaatacagaaattagccaggtgtggtggcatgagcctgtaatcccagctgagacaggagaatcgcttgaatccaggaggcagaggttgcagtgagccgagatcgcgccattgcactccagcctgggcaacaagagcaaaactccatctcaaaaaaaaaaaaaaattagccaggtgtggtggtgggcgcctataatcccagctacttgggggagactgaggcaggagaagtgcttgaacccaggagttggaggttgctgtcagccgagattgtgccactgcactgccgcctgggtgacagagtgggactccatctcaaaaaaaaaaagcaaaaaaaaaagcccgataacttcccattcccccctcacactccaagcaacatcaactgtctgtctcaatgaatctgactactcctagcacctaatctcagtgaaattatacagtattgtctttttgtgactggcttatgtcacttagcacaatgtcctccaggttcatccatgccgtagcgtgggtcagaatttccttcccttttatggctgaataatattccattgtacggatggaccgcgttttgtttatcttttcatccaccaattgacgggttgctctatgttcttatgtgaataatgctgtgaagccatggtgtccagatatctctgtgtctctgctttcaattcttttgggtatatacccagaaatggaattgctggatgatatggtcattctatttttaattttttgaggaactgccatactgttttccacagcagctgtaccaccttacattcccgccagcaatgcatagggatttcaatccctccacatcctcaccgacacttgttagtttttattttttgatagtagccatccttatgggtgggaggtcgtatttcattggagttttgattttgcatttccccgatgattaatgatattgagtaccttcatgtgcttatcgggcattcgtgtctcttctttggagacacgtcttttcaaatcctttgaccatttttgaattgggttgtttggggtttgtttttgtttgtttggttgtttggttgttttttgtgtgtgtctgtttgtttgttttggagacagagtcttgctctgtcgtccaggctggagtacagtggcatgatcttggctgacagcaacctctgttttccaggttcaagctattctcctgcctcagcctcccaagtagctgggattacagacatgcaccaccacgcccagctaatttttgtatttttggtagagacggggtttcaccatgttggccaggctgatctcgaactcctgacctcaggtgatttcgcctgcctcagcctcccaaagtgctgggttacaggcgtgagccaccatatccggccagttgttttttgttgttgttgagttttaggagttctctataaatcctggacaattattccttattaaacatacatgatctgcaaatattttcccgcattctgtgagtgatctttatactctgctgatagtatattttgatgcgcacatttttaaatttttcatgaggtccagtttattttttttattgcctgtgctattggtgtcatagccaagaaatcattgccaaattgcagataagacattggggggacacgaagaaacttctgggggtgatggatctgttcattatcttgattgtgatgacggctccatgagtgtatattatgtccaaactgatcaaattgtgcactttaaacacgtgcagttgattgtacagttatacttcaataaacttgtaaaaaataccaccaatattcaactctcagtactattgctaaattttcaaccataggagaatatttgaatatattgtggcacattcatatgatacaacgccattaagcacttataaaatatttaataaaagtatgtgatgaccagagaaatcctcacactgttatgctgaatgaggaaagtaggttgcaaaactatataaaaatatactatcaatactgttttatatataatatatattgacaggtattttatacctatgcaagtgtagaagtagaaaataatactaaaactataatgtgatcatatctagatggcatgtctataatatactttcaccgcattaaaagaattttctaaaaggcataatgtatcattctgataatcagaaataataagctaattttctgtattaatttttttttgaggcggagtcttgctctgtcgcccaggctagagtacagtggcgtgatcttggtggctcactgcagcctccgcctcccaggttcaagcgattctcctgcctcagcctcccaagtagctgggattacagacatgtgccaccacgcccggctaatttttttgaatttttagtagagacagggtttcaccatgttggccaggctggtctttaactcctgacctcaaatgatccgcctgcctcggcctcccaaagtgctgggattacaggtgtgagccaccgcgcctggcctgtactaatttttaaaaaaagaagcctgtgtttcttttaatattataaaacaaaaaaataataatttagaaaagaaaaaggtgaggcaaaataaccaattatcgtcatggctaccatttattggagcttcctgtgtgccaggagctctcctaattgctttgaagacttccttacataaaccttgtgggtgagacagcactccattttatagctaaggagaccgaggccaggaatcatgtccccgggtttcagaatggcccacagcagggcaggatggacagctaggcgtgacctatgggaagctcacattcctgactcttttggcatatgccttccagagacagcagtcacatcaactggaaaagaagacaacactctaaaaacaacatctatgaaagaatgcctctgaaactgtgtccacttctccccttcacccctgctcctggctcagaaactatcaacagtcagctttgtctgccagtcaagctcccatccatagatgggcactgagcccgccccacacattggcctggtcgcctctttccttgttttccctggcatgagtttcctagggctgctgcaggaaacaccacagctgcatggcttaaagcaacacgaatgtgctctctcacacttctggatgacagaagcctgaagccaaggtgccagcaggccacactccctctgaaagtctaggagactcctcctttgagtccccccagcttcgggcagttcctggcaatctgtggccttccgtggcttgcagctgtatcactccagtctctgctccatcatcacgtggccttcttccctctgtatatgggtctactgtgtctctgttttctctacttagaaggacaccactcactggattagagaccaccctaatccagaatggcctcatcttaactaattgcaaagaccctatttccaagtaagattgcaatctgaggttccaggtggacatgaatttgagggaacactcttcaatccagtataccccttaccatgcccccactagatcacaggcaaacatgacagctcacttcctttccataccccaggacctcctctccccaggatttgcttatgtgggtccctctctctggtcggcctgctctgcctctctctctcttctaattcttcccactctccaaggccccgctcaaacactacttcctccaggttgcttcccttcaatccccagggaagccactaagcaaagtgtctgaaacatacagcaggtccaacatatgctaatttccctttatcccttggaaaatccttagaaacttatcagtcttttttttcatgtgttttgcttttgactttgtataaaagtcatttgttgatacaaaaaccagacgaagacattacaagaatataaaactttagatccatttgaatagacccaaaaatcttcaacaaaatactagcaagctgaacccaacaacatataagaagagttgtacaccatgaccaagtgcggtttatctcaggaatgcatgactggttcaacatatgaaaatagatggatgtaagacactagattagtaaaagaaaagacaggaaacacaagatcatctcaacagatgcagaaaaacatttgacaaatccaacagcatttcaaaataaaaacattcactaaactaaaaacggaaaggaacttcctcaatctaataaatgttatctatgaaaaaccaacaactataaaaaaaaccccacaaatttaagtgtgaaagactaaaagttttcccccatataactgggacaagacaaagatattcactctcaccacttctagtcaaccttgtgctggaaggtctacctgggaaattaggcaagataaagaaataaaatgcaaaaagattttaaaaataaaatctttaaaagaaataaaattttaaaaaggaaaaggaagaagattggaaaaaaaggagtaaaactatctctattaacagatgacatgatctagcatatagaatatcattaggaatctacacacatacacacacagaaaacccactgaaaccaataaatgaagtcagtaagtttgcattatataagatcaatgtctaaaaattaattgtatttctatacactggcaatgaacgacacaaaaataaaattaataaaacaattctcttcacaatacacgtacacacacaagtacaagacttgtgtacttaagactataaaagttgaaacaaattaaagacctaaataatcagaaaggcatcccacgttcatggattggaagacttaatattgttatgatggcaatactctccaaattgatacacagattcaacacagttcctatcaaaatcccagctaccgtttttgcagatattgacaggttgaccctaaaattcatacggaaatacagaggacccagaatagccaaaacaacattgaaaaattaggactcacacttcctaatttcaaaacttaactacaaagctacggtaatcaatatggtgtgataatggcataaggatagacatattgatcaatggaatagaattgagagtccagaaataaatccacaagtttatggtcaattgtttccaacaagcttggtaaaacaattcaattgataaaagaataatctttaaaaaatttttttgagacagggtctcactctgtcactcaggctacagtgcagtggcgagatctcggctcactgcaacctccgcctcctgagttcaagggatcctcatgcctcagccacctgagtagctgggattacaggcgtgcgccaccatacccagttaatttttgtattttttggtagagacaggatttcaccatgttggccaggctggtctcaaactcctgagctcaagtgatctgcctgcttcagcctcccaaagggattataggcatgctgggattcgaggcatgagccgctgcacccaaccgggtgaaagaatagtcttttcagcaaatggcacagagacaactggatagccacatacaaagaatgaagtcagaccataacctcacactgtctacaacaattaacttaaaatggatcaaagacttaagtgtaagagctagaactataaatctcttagaagaaaacatagatactttgatatgacaccaaaaagacaatcaaccaaagaaaaaaatagataaatctgatttcataaaaatttaaaactcaacactatcaagagagtgaggccgggcacggtggctcacgcctgtaatcccagcactttgggaggccgaggcaggtggatcacgaggtcaggagattaagaccatcctggctaacatagtgaaatcttgtctctactaaaaatacaaaaaattagccgggcattgtggcgggcgcctgtagtcccagctaatcgggaggctgaggcaggagaatggcaggaacctgggaggtggagcttgcagtgagctgagatcgcaccactgcactccacagagccagatgccgtctcaaaaaaaaaaaaaaaaaaaaaaaaagagtgaaaatacaactcatagaatgggaggaaaatagttgcaaatcatatatctgacaagggactagtacccaaatattttttaaaaacacttaagatgtaagaataaaaagacaaatgactcaatttaaaaatgggcaaataatttaaatagacatatctccaatgaagatataaatggccaataagcacatgaaaaattctccacatcattattccctggagaaatgcaaatcaaggccgagcgtggtggctcacgcctgtaatcccagtactttgggaggccaaggtgggcaggtcacctgaggtcaggagttcgagaccagcctggccaacatggtgaaaccccatctctctaaaaatacaaaaattagccgggtgtggtggtgcacacctataatcccagctactcgggaggctgaggcaggagaatcgcttgaacctaggaagtggaggttgcagtgagccaacactgcaccactgcactactgcctgggcaacagagtgagactccatctcaaaacaaacaaacaaaaagaaatacaagtcaaaaacaacgttgagataccactccacacccactgggatggctataataaaaaaatgggaaataataagtgttggtgaggaggtcctagagaaatcggaaccctcattccatggtgatgggaatataaaatggagcagccaattgtggaaaacagtttggtaggtcctcaaaaattaaacacagtgttaacatttgaccaagtaattccactcgtaggtagatatcctagataatagaaaatagggccgggcacggtggctcatgcctgtaatcccagcactttgggaggccaaggcaggtggatcacttgaggtcaggagttcgagaccagcctgcccaatatggtgaaaccccatctctactaaaaatacaaaaattagccaggtgtggtggtgcatgcctgtaatcccagctacttgggaggccgaggcaggagaatcgcttgaacccgggaggcggaggttgcagtgagccgagatcacgccattgcactgcagcctaggcaacagaacgagactccatctcaaagaaaagaaaagaaaagaaaatagatgtctatataaaaacatgtacacacatgttcatagtagcattattcatcatatccaaaaagagaaaaatgcccatcaactgatgaccagataaggaaatcgtggcatccatacaatggaatactgttcagctataaataggaatgaagtaccggcctgttacaacacggatgaatcctgaaaacacgatgctaagcgaaagaagccagtcacaaaaggccacgtgttctatgatttcatttatatgaaatatccagaataggtaaatccatagagacagacagcaggttagtggctgccagggctggggaaggaagggctgggctgtgactgctagagtatgaggtttctttttggggggatgaaaatgttctggaatcaggttgtgattacacagcttcatgaatgtactaactgccactgcattgtacactttaaaagggtgacttttatgctatgtgaataaaaggtcactatgcacccgctctctcccgtctgatttatcttgtacatctcccaccaaagggtcttgtacaaagcatggcctcagaaaatatttgttctgcaataaaaagttctgggtgtcccccaccctctcaacctgcagacaacgagacaaggttgccacctgtgtagagcttcattgtggtgggaagtcaggcagcaaacggtaaacgggtcatggggtgctctaagggaatgagcacagggtgggaggtggaggggctgggcacggccactctagagaggtggacctgggggtcctcagtgaagcctgcagaaaggtgaagagctagcagagagcccaggggaaatgcatgcctgaaataagctaagcacatcagagaaagcaccagtccttgtacgagtcccagtgcaaaaacagcgccaccctggaaacggagagtcagcccggtgcaaaaacagcgccaccctctggaaacagagatgcagtttgctcttgcattgttgagttttacgttcctcccagtgtgggaatggaagtgatctcatattgtaaataattttacattaatatacactccctgtatttttattttttatttttttttgagatggagtctgtctccattgcccaggctggagtgcagtggcgctatctcggctcactgcaacctccacctctcgggttcaaggcattctcctgcctcagcctcctgagtagctgggattacaggcgtgcaccaccaagcccggctaatttgtgtatttttagtagagatggggtttcaccatgttggccaggctggtctcaaactcctggcctcaggtgatccacccacttcggcctcccaaagtgctggcattacaggtgtgaggcaccgcacccggcccacactcccagtattttttaagttgcttaacatttgcaagtggtaaataaattcacgttgtggttaaaaattttaaaaagactgaagtgtgcagaatcggcattggaagcctgtcccccaggtcatcctggtctggaagccctgtcccccaggtcatcctggtcagcagttgagtgactcttcttccaaagttcgttctgcaggtttacacacacttgaaggtatcttcccatgttgctggtagacaccattttggaataatggctcaggggcaattagaaaagaagagtctttaacgtattcttcaacttgactcataaaagtagagtcaatcactcttctctacaacagtcaacttctctcaaggaagacctgaggaagctggtgcccgacccaccaggagacatggacctcataggaggtgagctgaggatgtggataatttggacaccacttggactgtgagctgctgggaggtgtcagacaggagcatcccacggggtagggatgggggctctggaaggcttcctctcggagcaggtggcatgggggctggctgtgggggtctttgtggggaagaaagagcctgagtgggtgcagggacaaggaaggtctgcggaggacaggtcggagtgctctgaaaacggccctggcattgatttttaaaaagggtcgctcaaaagaactgaaagcagggactcgaacaggtatgtgtaccccgtgttcacagcagcatcattcatgatggccagaggctgaagcagcccagtgtccatcgatgggtgaatggagaaagaaagtgttgtccctgcatgcaatggcaggttatttagctataaaaaggaaggaaattctttttttttcttccccctgagagggagtcttgctttgtcacccaggctggagtgcagtggctcaatcttggctcactgcaacctccgcctcccggattcaagcgattctcctgcttcagcctcctgagtagctgggatcacaggcgtgtactaccacacctggctaatttttgtatttttagtagagacagggtttcaccatgttggccacgctggtctcgaactcctgacctcgtggtccacccgccttggcctcccaaaaaaaaagtgctgggattgcaggtgtgagccactgcgccctgctaaaaaggaaggagattctgacacaggctacagcatgaatgacacctgacgttacgctaagtgaaagacgccagacacagaaggtcaaaccctgcatgattccactcctatcaggtccccagagcagtcaatctcagaggcagaaagtagaatagaggctgccaggggcttgggggagaggagatggggagttgtttaacgggaacagagtttcggttgggaagatgaaaaagttctggaggtggagagtatggtgatggctgcataacaatgtgaatatacccactgccactcaactgtgcacttacaaatgattaaggctgggtgcggtggctcacacctgtaattctagtactttggaaggccgaggcaggagtggatcgcctgagcttaggagttcgggaccagcctgggtaacatgatgaaaccccgtctctactaaaatacaaaaaattagccaggcatggtggtgcctacctgtaatcccagctgctcaggaggctgaagcgggagaatcacttgaacctgggaggcagaggttgcagtgagccgagatcgtcctgctacattccagcctgggcaacagagcgagacttcgtctcaaaacacaaaaatggtaaattttatgttatagtggtacctccttatccaaggggaatacaacccaatacccccgttggtgcctgaaaccttggatagtgccaaaacctataaatactatgttttccctatacatacacacctatgataaagtttaatctacaaattaggcacagtaagagatgaacaacaataataataaaatagaagtggctgggcgcggtggctcatgcctgtaatcccagcactttgggaggctgagacgggtaggtcacttgagcccaggagttcaaaaccagcctgggtaacacagttagaccccgtctttataaaaaaaattaaaacaaagtctgggcgcagtggcttacgcctgtaatcccagcactttggaaggccaaggcgggcggatcacaaggtcaggagatcaagaccatcctgtctaacatggtgaaaccccgtttctactaaaaatacaaaaaaaatagccaggtgtggcggcgggcgcctgtagtcccagctactcaggaggctgaggcagaagaatggcatgaaccccagaggcggagcttgcagtgagccaagatcacgccactgcactccagcccaggcgacagagcgagactctgtctcaaaaaaaaaaaagaaaaaaaaattacaacaaaaaattatccaggcatggtggtgcatgccatcatcccagctacttgggaggctacagtgagccatgatcacactactgcactccaccctgggcaacagagcaagaccctgtctcaaacaaaaacaaaaccaaaaccctcccccaaaacaatatactgtaataaaagttcattcttaccagaggtcgtagcaacctcagcacagaattctgttctttccttattcagttgagaacttccgccttctcgctaaaaggaagcgctttatggcttctctttggcatatccaaattgtcagcatcactgctctggtgctgtggggccattattcagtcaaataaaggtgacttgaacacaagcactgagatcctagggcagccgatctgatcacccagacagctggcgggatggagggggagggtaggagacttcattactctaccagaatggcatgcaatttaaagctcatgaattgtttatttctggaattttccatttaattttttttttctcttttttgagacggagtctcatctgttgcccaggctggagtgcagtggtgcaatctcggttcactgcaacttccgcctcccgggttcaagcgattctcctgcctcagcctcccaagtagctgggattacagacatacaccaccacgcctggctaatttttgtatttttagagagacagggtttccccatgctgcccaggctggtctcgaactcctgacctcaggtgatccacctgccttggcctccccaagtgctggaattacaggtgtgagccactgtgcccagccccatttaatacttttggattatggttggccgagggtaactgaaactgcaaaaagcaaagctgcagtgaggggggactatatgtattttattgcaactaaaaaccaaaaaacaggtgaaccatagagtttcttggcttcctccaccctaaagcacattcccttatcttccctggctctcccaggctcttctcaggcgtggcacccacacagtagggctagctaaccctggggacccagcaaaggctgcaccaactcacaggtggggctggtaggaggctgggttcacgctcaggtttatcttatgatgctgaggagtttgtggaataggttcaaaaacgttgaaagagggagaagcctgggcgccttgctttcagagtgactttgtggctacctccctgtccgattcctgatttggcctcggtttttgcctttgacctggggttggggccacccccgcagccactgcgccctctataggtaagaaggcccaaggaagaagccctctgctccgtcacctcctcgccatgccgtccccactgccagtgggcgcaacgttacttgcaaggccacaaacacccggaacaatccgccaggccgcgtcactcctcaccctccagcagggctttggatttttggacagcgagttctgtttcattttgttttgtttttccctttgcatttggtgaactccgtgtcaggaaagctagtctttgggattcaaggaagaacaaaacaaacccgatctcctgtaatctacctggattggaacgcccagctttgtacagcctgagctctggccgactggaatttctgccaggtcctattcacacccttggccccagctggctgtgaggtttcctgggaacccttgcctcctacatggcctacttaaaaggctgctgagagccagccaggtgttctttaagcccctgtgaagattccttgatcagttacacaaaaagcttgctcaaaagaatgggaccgggagcaaccgcaatgccctctggagacccagctcctgatttcaaaggatcaacgagtgacagagggttggggactgggggggtcgtgcatgaagacagccaccgcccacaacaggtccaccctgaagtgaaaagacaaatatcatttttcctccagtttgcaaccaactgtgcacagcttcgggacccccagccagcccaaacctgtcgctggctgcccactaacgctcccagcagcccttagtacaatacaaattcaggcaatgcctgcgtctgcccacacctgcagagcatgagccccactttggaatgacggggtctgtgcagagaccgggcagagctctgggcttcaggatggcagcagcagctccggcaggcggctctccaggccacgagatgggcacagaccttcctgcaccctcacagcttctgcggctccccaggcaacggagccagtcagggcatggggacgccaggcagcagtgtcagacttggccattgccaagttctctcttgtccccgccaggcagaacaggtgcacatccaggtcaacctgtgacctcggccttactaacccttgtctaggcaaacctgggagcgagatggaatcaaataagaaccaacctatactgggcagtgattactctaaaagcttatgcaagagccctgctcctctgttggtaccctacatgtcgatgccgagactgaggctcagagaggtctggtcattgctcacaccggcccctgcactgtcccaggctgtctctcttgcagcaagggaaaatggctctttagcctctgttatgttttaaccataaggcattttctcacgcagggctttccaatgttggcccacagacaagaagcccactggacatttgggaagaggagttttagagagaagaggatggaggaaggctagagtcacggtattgtgtgtgcacgtgtgtgtgtttacacgcctgaaacgaatgactgcgtcggtcacatgtgcggtgtgcccacatccttcccaacaaagatgagctcaaaagcgtgagggaaacacaccgtgcaaagaccagcttaggggattctggtgaatgtccagagatccaaacagcaagacccccgccgctcctgactcagcagggatgctggatgcaaactggccctgatacactgggccctggggtcttctccacgtcattatcctggagggtttaagtcccccgaggcaggagccaaagggaacagcaagcttgagatttttctgaagcctcttccgttgacagtgcctttccattcatctgaaacaaactctgaaggactcctctctatggaatcggtccccagaggtggaggctgctgctccatcccagcccctctcatcccatcctctcctgcttcacgcagcccaggtgaggcctgccctgcagaaggctacagggaacacgggatggggcagtttctacctgcctgctgagctgctctggtgacttaaaacaaaagtgtcaggagcctctggcaggaggaagggaggaataaaatccagcattcaacccaagcatctctgttgcccatgaattcatccttttcagtgatccgtccaccagaatatcctactttgcctgggtcatttcacgccttccccaacgaggcgaaccccagcccaacgtccaaagctttcctgaagccccactgcctccaccaccctcagtaagcgaagagaagggaagatgcatggagccccgccccatcccagagacggcccggtgcacagggacgtgcaggtcacacagattacaaggctgaggaggggatgggatgggaaggggtccgtgtggagcagcagcctccacctccgggtctctgactccaacgaggcagagaccaccttccctgacgcctcatccctccacctggccccttcccagcatctgcaacccactggtgtgtcttggtcccccaggcaagggtgatgtctcagccatctctgcaacccttgccccacagggcctggcacgcagcaggatgggggtgacggaggagagagagctctccgcaccttccttcccccacctgtgagacggcgatgagttggctggacgctacgatctctaggaaccccattaggctctaaaatcctggcagtttctaaaatgcacagtaagctaactgttcccagcaaaactgaagcacgtctggcataattagcatcacacacacatgtgcacacggcggtactggactcatccagccgagaggctggactctgccagcttcccgctgaccacagaggcagccagacccagctctggagtctgctcgcagagcccagccggctgtgcacgggagggcgattgatgcggctgccagttcgaagaggcagagcaataaagcctcggcgactgcggtgccttctgctgccggggtgggacccctaagcttttcagaggcctggatgctgaggggggcccacgggaagctggctctattaggctcaagctgccatttctgacataagtggcaatgttaagtgatgggcgcacagccggccggattctgccatcccaggcctagaacctgccccatggtcacggtcgagctcgggagcgccgacatcccgcatgcaccgagacagcctggcttttccagccagagggactgggagcagcaaggccggaaaatacagggccaagcggggcggggatgaatcgcagctcctcgcggcatgggcggcacactcccagagccagagctgctgggaactgggaaggcagggtctccgctccggcgattaactctgccgatctgcaacatcacggctaattagggaaggtgtaaatcactgggaggaagcgggcaggcacatccttcaggttgattaccagcacggtttaggaaaagataaccaggcccggcctttcttctgttcctttgccagccgtgggggcggggtgggggccgtggcgggcgggcaacaatccgcggcaggtaggaggagagaatgtaccaggcctttgagtgctgtttctgttttaattttttcttagtcatatggagtgaccttgtggatttcccagggaaattaagaaaaattccactgaacagatctcacagctgttacgagtttctgagcttccgtgggtcccgtgcatttacgactgtgacgacttagactcaggacgtgcacgtgatgccgtactgggctttttccattcagcgtgattacacggtgttattcattaagggctggagactctgatggcaggaatcatttgtttttctttttcccttaaggcatttgcaaatatgcttggaggcaaagggacgctgggtacatctaataaataaagcaaaataattaatagctcaagcagtctagagaccactcccagttgctcctgaaccaggcttttgagagccaatcgttctgttttcattccctctcgacttcgtccttgaaatacacattactgggaagaaaacagccaagagatttttctgaacccaaaaagaatgtttattttttttcccctagattttataggagcttaacgtgggcaaaccaatgagatgattctaaaccaaagcgccctcgtgggctccacgctctcagcctgtccatcagcagcacacctgggagattctgcccaacctagggaaaggaggagccataggagctgggcagggaaggccagagcacacacgctccggggacgcacacccacgcctagagcacacacgctccggggatgcacacccacgcccagagcacacgcgctccggggacgcacacccacgcccagagcacacacgctccagggatgcacacccacgccctggaccccagcagagggatcaagggctcaggcatccccagtgccgccaatcacgtggccctctcgaggtgaagctgcgacactgtgtggaaacccaggggagatgggagaggcctgaagcgggaggcgggaggaccgcatagctgcaaatgcatctgggcgtgaagacgtccctgtgtcatctctgcaggaccaaacagtcaattagtatccaaatacttttaggggacagaaagacgctcacggttcctgtcgcaggtccaggttattcggtgccataaaaaggcacacgtcgaccttcactgtttcctgcaaacacagctgggacatcagcccggaaaggaatgtaacctgtcaggccgcaaatcccacggttctcactaggagcaggaaaggaccctggtctcccttcacatccaccaaaagctcaccctgactagagaaccaagcagagactgaggccagagaataaccaagtagcaaggaggggaggggtcttcacagacagaggccttgctatgggtgggctctggcttccaggtggtgggctctgcgggccagagcttggggcgcaggaggccaaggtccaggtcccagacacatccattatggccaaacacaagaagccctcaggcctgcccaacacggctgtgggcaccggtgcctccccagaccctctgggcagcccatccttgcacctggaggagcagctcaccgtgccgtggagggtggccgcgaggttcatctgggcctccgagcctcccagcgcatcccactgctctgcagaaacagaataatcaccacccaggctggtggcttcccaacttttccgtgacgttcccctaggcaatttaaaaatggagtgaatactgataataatttgactaaatttaggtgttccccttaggcatctgattaaatttcatgaactctttttcaggcttgcagcccaaattccccttctctcttggcttcacggcacgggcttcttgaccaccatgtagggtcagcaaattccgcctaacaagccggagctttccttccttcccggaggaacaagacactaagaagaggttcccaggggaacatgcagtgggagtctgggccgctacgttgtggggtggtgtaaccagggtttgtccagaaaaagacacagaacccgcaggccctggaggaccctgaagatcaccaggcccagtctgttcctctccctaaccaggacactgtggtgcagacagtgtagggactggcgaagagacacagtgggtggcaggaacggggaacagaaagccagaaccttctagattctgagctgctgggctttgtgacatcccacatggcttggtcccgcctttcagccccccagggttcactcgaaccgcctccgcgcaccccaacagcagagacgtaacgtgcaggactgactggtgcttcccaaaaatcttctcggactcagtggcacacctgggactgcccgaatctgtgccctggtccccgttactgttcctgcaggctggaaggggagcctgtgagttgagccagagctgaccgggagctgctgggaccatggctaggggttgtgacgtgacctgggccccgggaggccctgagggaactggtgggtactctccagcaccccaaccccaaagggcaaacagtcatgataccaatcaccaacatcctttgataagaccttggctactcatttatattcatttaaattccatccacacacttgtcacagcaaagctgaattctgtatctagcccctcgtggcagcagtgacggaaggacagaacttgtttaggcatcgtttcctcgctccctccttaatctccactcggcttttcccatcccctgggcctagtttcaggggagccagcatcttccgcaccaatgcactgcttggcccggctcagaggatttgacgcaaaccaggactggggccctggccgacagaaaattcttagagcaaaatggctgttcaccagcggcgggtatgttcttagaccctccatctgcccgggccctgctgggagaaggcctcgggcctccacctccagcaatcctctaatacctcctcagagctttccggagagaagggaggaagccagggaagctctgggtgcccccgacaagtttaaccccttccttctttggcacacacttcacaaaagaagacaccaggtgaacaagcacgcagagacatattcaagatcgtcggtgataaagaaatgcgcatgaacatgatttttaagccatcctaccagcaacacttcgttttccaaagcggggaggccaaacctccaaagctgggagggctacagtcaaagaagcacctcccacaccggaggcaagggacgcgccaccctcggagcggctccctcggctcttctgtaatctcagcaagaacgtgctcactgcacataacgctgaacctgccacgggcacgaagcagacccacatccgtccctgcagcagcagcctcggcccaacctcaatcccactcctccaagggcgcgccagggaacagcaggacgcggccctccggggcttccctgtgcgcacacacacacgcacacacacacacatgcacatgtattaaagcaaaagtgagattgtgctgtcaacattgtgttacgcctggaatttttcagttactatatccagggccttagccctgtcggtatgcagggataagctgcacctctttttgagggccgcttccacgttttctctaaacattccttatagacaaagacttgggttgtttccattgtcgtttttctttgtgtggtttttttttctttttttttttttgagaccgagtctcactctatcacccaggctggagtgcagtgacacgatctcggctcaccacaacctctgcctcccagattcaagcaattctcctgcctcagcctcctgagtagctggaattacatgcgcccgccatcaagcccagctaattttgtatttttggtagagacggggtttcaccatgttggccaggctggtcttgaactcctgacctcgtgatccacccacctcagcctcccaaagtagggggattacaggcctgagccactgtgcccagcttcatttttctgtaaagtcaataatatcacattgaacttttgtgtgttcacgtctgcacacaatacaccgaacctgtgtgtgcacgtgtgtacaggtaccgtgcatctctttaaacattccctgaggcttggcgtggtggtggctcaggcctgtaatcccagcactttgggaggctgaggcaggtggatcacctgaggtcaggactttgagaccagcctggccaacatggggaaactccgcatctactaaaaaaaaaaatacaaaaattagccgggtgtaacggccggtgcctgtaatcccagctactcgggaggctgagacaggagaatgacttgaacccagggggcggagattgcagtgagccgagatcacgtcactgcactccagcctgggcgacagagcaagactctgtctcaaaacaaaacaaaaaaattccctgtaggcaagaattgggatgttactcattccacttttttgtaaaataaataatatgacattgaacttctttgtgcatgcatatgtgtgtacacgtaaatactgaacctgcgtcatccacgtttgtgcggaatccctgtgtgtgtgcacacgcatccaccccgagcctctgtgtgcagagctccaagcacagacgtgttcatcaaggacaagcgggaagccgggaacagctccatgtccatggaaggggcatgggcaagtgaaatgctacgtccctcaccaacaggccgctgtgcaggcgtgaaacccagtggcggttcagaagacgtggcagcgcgggaggggtttatggcagggcatgaattgagaatggcaagacagaccatgtaatctcagggactctcagctggccccaccccaggaaatgcagtcggtgtgtcttaggaggttgagtgcacattgcagggcccaggggcccctcggaggggctcctgtccctctgcaccaaaggtgtgcacagaagctgtcaaggtgacatcattcacagagaaaaacccaaactaaaccacatggtcatcaacaggagtgtggacaacctggggaacagccatggagacagtgtccccctattggagtgagcacccgcagcacctcaggcacggggagctgagccaccgacggctacaaagacggggacgctttcctagggctcaaagcaaggcagaatgttgagaagtgcacatgtgtgcaaagcctgctttaggagagcaaggaagtgccgcccacggcattccggaaggtggttccttctggagaccggggcacggaacgaccagactggggaggaaggagtggagcactggcctcctaggaagctctagttcagacacagggggcgctgggtcacggggttcatttatgattgtgtttcatggtttacatgctacaaatattctttggcatgtatcaaatatgacaaaatttaaaaaaaatttaaatttatttagagacagggtcatgctctgtcacccatgctggagtgcaggggtatgatctcggcttactgcagccttgatctcccaggcttaagggatcctccctcctcagcctccctgagtagctgggactacaggcaggcaccacagcacctgactatttattttgtattttttacagagatggcggggtgggggggcgggggtctcatttgttgcccaggctgaccttgaactcccagactcaagcccatcctcttgcctcagcctcccaagtagctgggaccacaggcatctgccagcacgcccagccaatttttcaatacttttttgtaaagatgggatctcacaatgttgcccaggcctgaagtgatgctcccacctcagtctcccaaagcactgggattacaggtgtgaaccactgtgcctggcctaaaatcaaaaaaaattttaaaccaagaaagtgaattttatatacagcctgcctgtctacaactctgtaaaataacttaggcatcggaagcaaaaataaaaaataaaagtaaacacaaggctgaaggaaatacaccaaaaagttaacggtggtgagctgggtatggtggggcttcacacccttcttttgtcttttccctatctcccagaatttccttaggagcaggtgctacttttataattaaaaagaaagaaagagagagagagaaagaaagaaaaagaaagaaagagaaagaaaagagggagggagggagtgaaggaaggaaggaaggaaggaaggaaggaaggaaggaaaggagacaaacaaaagccctccaaaacatggaaaacagtaaaggcaaaaaaaaaaaaaacagttaaaaagagcaaaaaccaccctccccaaaacaaaaatagccccaagcaatccctccataggatcaacagggaactaagacaagcaggtgaaaagaccacactgaagtcagacctcagatcataacagaaacaaaaagcaggtcctaaggcctccctctggctcccccccacccaccccaccatcctccagcttcggacacagccctgcgatggagctggggctatgttttgggggctgcgttttggtggtgacacagcatttcccagggctgctgtaatgaaggaccacagaccagaagcttgaaaacaacagaaatgtattgtctggcagttctggaggtcaaagtcaaggtgctagtcgggccgcgccccctctgaaggctccaggcaagagtctttcctgcctcttccagctggaggtgctcgtcctggatcctggaagcccccaagcctgcagcagcatcactcccatctctgcctccatctccctgcccctcctgtgtctgtgtgtccgtccgtgtcttttaaagacatccgttggatttagggccaccctaatccaggaagacctcaactggatccttcccttgatcccatcagcaaagaccctatttccaaataaagtcacattctgaggttctgagtggccatgaatttgcggggaagggagtcactatccaggccacggcagacacagttccccgaaactgaagacgtgtttactcactttttttggacagggaagctcggctgtgggtgcgaagcaggactgccccccaaggccaggcaggtcctcgaggagcatctcccagtccagtctcagcgggcactggcctggcactcacgctcggggtggggggcatcccaggccctgagactggtgctgggtccaagggtccccatccggtggcagccattccgcattgatctccatttgcttttcaaacatgcaattctcataaactgtgctaaatgccatttagtagctaattaactttctgtgtgaagacctctctaattgcgcacactcccccctcggctgggtcctcggggatgcccagctgtcctagagtatttgttctgctggctcccacctcgcagccacaacttcaatgcccacaacaaactgccaatcaaggctgtggaggtcaaaggggaccaaatcaggggccctctgctactaccaaactctcccggcaaagcttaatttaaataagaaagcagaaaggttatgaaaaaccatttttcccaacgaaactcttctgccaggcggcataaggggcgcggccctccgctcttcagaacggctggtgtctgctttgaaaggtcctgactagaatctgtttatattttgactgcactggcatctgccatccctcaaacggagagataatcaggaaataaaagcttttgattagcagctgcatgaatcactgcagtgccaatttcctcgtggtcccaaagtgcgggagggagggcaggaggcggcaagcatgggtgctgggtccacctcacccacttggggcaaagccatctctcactttattcactggtcttggacttggggccccaggtctatatcccaaggccacgttcgcttcataaacgcaaggtgatctctgagcacctcttagacagaagtctgggcagacgcaaatgtgcagcgtttcaaagcaaagctcaagagtggattcctcagtgcagtatcgtcagcgttgcagtggtgggtaagaggccccgggattatttttggagggcccctccctgcagagcaaccacgtgaggactccctaccccaggaccttccaccagaaaaggccaaagagagaccacacgtgccgccccctgccgaagcctggcctttgaaggatgaacggcaaggggtatgtctgccctgacagagtgaccagtacccgcagcacccgagttctttgcctcttattaaagggcagagccaccatggtgggtgaacgggcttcctctcggaaaccaacatcctggttgggttttcccttccaaggaaggctctacacacccggccctcctcagagcctcagcccgcagcgggagatgacacctccgatcaggtccacgggaagatgggggtgaacgagaagcctgaggccgggccggtgggagggcgtgatgcatgggaggagctggactgcggtcagccgtcccctcgcgccctccggtctctgctgctgtgtttacttggctcccttcccgggatggccttgtagcaaatccatctgggatatgttttgtttccacagagggaccctgaattttgaggtggggccacagaacctcccttgagagccagaagagatcagggccaggatgggtcacgggctgtgcccagtgtcgctgcccaaggcagaactggctgcccaccaggggcaggagactggatggtctttccaggccctcatcccaaactcaagcactggagaaaattgttccagagcgtctcggtctgggtgggagcggggaataagcatttctttaaggaattttttttttacttttttttcagactgggtcttgctctgtcacccaggctggagtgctgtggtgacatcacagctcactgcaacctccgcttccacctcttgggctcaagcgatcctcccacttcagcctcccgagtagctgggaccacaggtgcacgccatcacgcccagctaaattttttattttttatagagatggggtctcgctatgttgtccaggctgatcttgaactcctgggctcaagcgctcctcctgcctcggcctcccaaagtgctaggattacaggcatgagtcatcatgcctgacctatttttaaaccagaataagcaggtacagaagtttgcctggtgaccaggagtcatgactctttccgaatgaaggtggggatgggggtagggaatgtccccatgaaggtagcccctggctgggcattttccactcccagccacagcctccctctgcgggcagaaccctgggtgctgcagggagctggttctcagggaaaagggaattaagtcagtactgggagatttgggttccacagagtttaggggctcctacaaacagcggcttacgggctggtgaggaatttcccatcctgaagcttttaaagcagacaaacacatgagtgctgggtgggggcggggtgctgggagatgcagaggctcagaaaaaccctccgaggctctcggattttacgcctgcatgagatttcgagggaagaatcctaaatgtggggaaatgaggttgcccagcaattctgaatgtggtttaaaaaaaaaattaggtgggggagaatgagacgatattcaatatttccttctgattcaaacgaaatacttctaagttcttctctgtgaaagcgtgtgtgtgtttagaagggagagggggatgatagcacgtcctgccagaagccgttttatttactagtttggatgcttcccctgacgcctacctgggaggtgcttgcctggccaccagccagggccgtggctcctcggcaagtgggcgtccgccgagcctttgatgcactctccaaagtcacagagcaaaacaacacgctgaacaaacaccaccaccctgaaaagtcaccagcccatgggcctctccctggctccagctgtggctgatttacccaaactgaaacattttccttttgtcgactgtagagagctatgagtcaggtccaagctccactgggcgtatgcccaaggggcagagggggcagcaaccggacggaagctgcccaatcataagaccatggctgaaagtcaaacgcgcccagagtccacagtcgaccacctcccgctcggcaagccagggtcctggtgaacgcacgtgcctgcgttctgtaccaaacagttgtcaacacacaccagcaacttaacaaatcaactccaacaaaggggaaaaaattaacattaagggcaaaaagactttttctggagggtcctatgcaccagatgttggctctttaattggcagtcaacctcaaagcaaaacttagaaggcccctgcttgttttatcagttagagccacagaaaatcaaagtccaatcccgctaagcatggtgctgtgtagcccggccagccccgtggaagtcctcagcctggtcccgtcttctgggctctgctgggctggacggtgccaccctccccaacccgcacctgcccgccggccccaggccctccctcaggacccagcaccttcagtcctcctgccgagaagaagcctttcatcagtaaaagagaaaacggcttctccaaaggaagtttcttaacttgaaaaaacaccatgattagggaaactcctccatcgtccaagatacaaacacaaactcccaaacacctgtcaatccttctcagggctccacatggcccaaaggacaccccaaatgtggaggaccactcaagaccctcaaatgcagcaccgtgtgccccctgaacagggatccccacattcgatgaaaacaaaattggccagcgcaggaacttttgcccatgacttaagcacagcaaagtccccaaagccagaatccctcccaggacctgcccgacgggttttatcactggacgcatcaaagcccctctcactggtggttggttcagcagagccctgggcctcgggcctgccctgctctgacagctcccacactgtggccttgatcgggcccttttccactctgtgcctgctttgagtaacaggctcccacaaaaacactgtgctggggtatttccaggatgaaaagccacggttcgctttgcctgccatggacagagtcataaatacgagttgtcgttgcctcttcccaacagtctggcatggcaaactggccttgtggagttcggaattgttctagatactgctcatgtattctccagcagctctagctggttctgcccagatacctggcaatgccaaaggccgagaggccaagacactacaacctttgttcaaatacacgaacatcctcaaatacacgaatgtcctctctgcacaagcagagcagcctcagcatcggccctcgcaagtcccaccagagaacggtattgaaaagatgactggggtcaaggggtgcggagagggacccactgtaccctcatggccactctagcgccagcccttctgtaatgaccccctctggattcccaaaagtcagccgaggggtccccaccctcctggggtggctggggtgttgctgcccacccccaggggcaggcctgtgtgcagcatccatgcccagaaacctgcgctcagatttcccagttcccagaagacaacagggagagtctatttttctaagctcactaggtaaagtgttacttcctgatctaatcttgccaggctctggaagcttccgtcaaggttttcccacactccatgtcaggtctctgacatgaaccagctttcagagtctaacgactagatttgactttcagctgctcggacggaggcttcaactcagcctgaactagccgcgtggacagcagccgtagccctcacaaggcgtgtgcggtgacgggtctcgggcgcccagccagcgaggggccggctccaggtggtgggagcccacgcccccggccagcactctggccacagcgcagcacctgccccatgagagcctcctgttgcagcccgggcagaggtgagcctgggcagccacctcccacgtgatttcccaatgcttgaagttcacgaccaattgctggggtggggacaacctacacaggcttacagacctaatccaagaaggcagttctcaaaaggatgggaaaacgtgcaccagtctcacagtcccagtcaccttaaaaggtcttaactgatttttccttctctctgtttattgtggtaaaatgtccataacataaaattcaccaccttaaccgttttcaacgtcgagcccagtggcattataccattcctatttttgtgcaaccatgacaccacccatctccagaactctccttcttcccaaactgaagctttgtctccatgaaacaccagctccccaacgtcccctccctcagcccctggcaccccaatctttccctctctgagcctgacaactccaggggtcgcacacaagtggaatcacacagatttggccccttatgtctggctcatttcactcggcgtaacgtcctcaactcatccgtgttgcggcgcgtgtcagaattgccttcccaaggctgaacgttccgctgggtgtgtgtggaacatgtgtgtgaacacaccgcgtttctctagtcacccgtcgggggaacttggacgctttcaccatgggctactgtggacggtgctgctatgggcaggggtggtcatgtatctgagctccttctctttatttctgacacttctatataaccatgaatcatctatgaaataattttgacaagcaagaggttcacaaagtaaattccagacaaagccaccctggagacccagctgggctgtcccgggggcggtccctgcgtccacgccgggagagcaggaatgacacaaagcaggctgcatctggctgtgtcaggcctcccacccatcccatcagccaggcatctctgctttggggccagaggtcaaacgtgtctgggttccgtgtagtctcaggggaggctgaggctgacgcgaggtggggtggggtgaggttgtgctggaggctctccacctctccacccaccagacacccagagaagaggcggaaagtcagcagggaaggcagaaggctgctaagagtggacaggatgcaggagtggcgtctggctgaccctgaccagggggacctggcccaagtgagtgtgcaccccagcccggccctcagaactgcttgcaggcacttgcgagttaatatccacgtgatttaggattcaccaaaatctgcttggaaggaggcagggaggcaagagggaggtcaggtggggaggcgcgcaggcagtgctgccctccagccacaggcaggtgggggtggggcggggcggggcggggagggggagggcgggggcgtgcaccgcaggcagcggccagccctgggctgatctaggggaagcctgccatctgctgggcaccgggatccctcccggagcaggagtgccacctccacgcagatggagtttgcaaggggcggtgccgccatcttcacagaggctccgggcagctggcgggggtggggggatggttgggggggccgtgttggccaagcccaattctggggtgggagaaaacgagcaacactctgcaaagggccgggggcctggtggcccccccatcctcgccggacctcaatgtcctgcgtacaagcctgtcccggccgtggccaccggctggcttgtgtgctccgcctgccgggaagcgctttccccctcgtggaccctacaaagacgcctctctgcaggctcccctcatgctgcgggcacacaatgcgtcctttcacccggggtgggtctggcggaggcggcccctccccggggtgccccccgctgggcccctgaccccacactccgctgctgttcttggcctgcgtagacccgtccctttcaaccgctgtcaggaaactgtgtggacgaggaatccctgctggtcgcgcccgagaccatctctctgcgtctcctagaaggggaaaccgtgacccacatcaaactgtggccgttggaaaggtgaacacacggagcctggggccggtggggccagggggtggggtatccttgcacccgatgtcacttgacacccgtcccggcagcccgccaggctcggagagagaccgtagctaccaaaaataatcctcccagtgtttaaatatttacagaagcaagacagatcctgatgcctttacaatctactggagtctgccctaaccgccagtccgaggctcccaggagaggccacagcgaccacccacccggttttcggggtcccaggtcgcctctcctctccctgtccctgcctgatatatatcgcagggctcctcctccggtgaccacatatctgccactagccctctccctccttccagaacattcccacttccaactctgctctcacatcaccccagccccagcacctaccttgagacagctctttctgctccagagcccctcggggaaagcctgctttctctgcagagcctgcacctcattttgggaaccagtgaacaaaatgtaacaagaggcatttgtccatgtaaccccattgtccatgtaacccctggggctggtctcgaccccactcccctcctggggacacaagggtgagacggtacagtaccaggccaacaccagtcccagcggatggcacagagatgggcactgctctcagggcctgtccagatgctacttctcatgacagtctatggggtggggagcactagcgccagccccattgtgcagaggggaaactgaggcaatgagggtaataacccaccagcacacagccaggcagagctgggatgtggccaaggacttggctccaggctcccacacttaaagatcatctctgtcaccacctgggggtaataaggtcagggatatgccccaggccgcctgcttccaccagccagtccctttcaaagggcggaggtttccagaagtgtggctgagtgtctgtctgttcttgatggtcagggaaccttactttcaggtccccaaagcagattccctgaggccaggaggcacttaggtggacgggcaccaggagccctgtgtcctctgccttgcaggtgtttagggaacattgttcagactggaaggaagagccacgtgaaaatgccctttctgtttactctgctgggaaggatatgaagccaaacagaaccagctacgggagtctttcgaccgcaagacaaaaggtcctttgcccccactacctgcaactttcagggaagatttcatcaggtgctgggttacattgcaacagccaggcgtggttccccagaggtacggtgtgagctccccaactcaccgggagacaggcgctgccacatcactgcctctgggagcccgtgacctcatgctcagagctctcagaagctcacgtggcctgtgaggcccctgccagggctgttgatgcaagagctggggctcgggagcctcccaagggcagctctgtgtattcagagcagctcagcccctcgagagcaccaggagcccccagcccccatgcaaccaccggccggggttgcgtcaaggcctcccggagcagctgtcaatggtttctgagctgcggtggaaaaggctgacaagtttcatttccctgaccttggacagccctcctgatgcagggagcgcccatccctggggagcactgcctctccaggagcctgaacttccttctttttggttcaggaggtttgaggcacttatttcctccctgtcctgacagttttactagaaaggtcagctttttaaagagctgtcagtccttcggaagacagtcaataacagcatggtttaagacggcccaccagatgcactggctccgcccccatctctttagaatccagctcccttgggggacatacctggctggtgacttctagaatcccagctcagggccgggggggtgccagggctgtgaacccccgacaagaggcaatgaaaccccctcctcctagaggctgcccaaccatcaaggacaaaggaagagggagtccatgaagaagggctggccagagaatattttgttttgttttgttttgtttatttttttattgagacgaagtctcactcttgtcccccaggctggagtgcaatggcgtgatcacagctcactgcaacctctgcctcctgggttcaagcaattctcctgtctcagcctcccaagtagctgggattacaggtgtctgccaccacgcccggctaatttttgtatttttaatagagacagggtttcaccatgttggccaggcttgtcttgaactcctgacctcaggtgatccaccagcctcggcatcccaaagtgctgggattacaggcgtgagccattgcgcccggccgagaatgttttttcaaaaaagcaggtcgccaatctgtgtagactcgtgctggccaaggcagtgaccccaagccacatgtggcatcacacttgagacgtggtctaggtgtaaagtacacgcgaaattcccaggacttggtaaacagagagaatgtaaaacacttcccatcggcggccgtgtatactgatcccacattggaatgatactattttgaacaagctgggtaatttacaaaaattttcacctttttgtttgttttctttttgttttttgacttgtaaaaatgtagctatggccgggcaccgtggctcatagcctgtaatcccagcacattgggaggccaaggcaggcggatcacctgaggtcaggagttcaagaccagcctggccaacatggtgaaaccccatctctactaaaaatacaaaaattagctgagtgtggtgaggcactcctgtaattccagctactccggaggctgaggtaggagaattgcttgaacccaggaggcggaggttgcagtgagctgagatcgcaccacggcactccagtttgggtgacaaactgagactccgtttcaaaaaaaaaaaattgtacctataagacccacacaaatatgcccaactgatattggacaaaagagcaaagcgtctcaatgaaggaagagcagcctcttcaacaaacgacgcgggagtcattgcacatccataggcaataaataaataaataaacctcgaccccgtaaaacttttaggaaaataacaggagaaaaccttcaggatcggccgggcgcggtggctcacgcctgtaatcccagcactttgggaggctgaggtgggcagatcacgaggtcaggagatcaagatcatcctggctaacacagtgaaaccccgtctctactaaaaatacaaaaaattagccgggcgtggtggtgggcgcctgtagtcccagctactcgggaggctgaggcaggagaatggcgtgaatctgggaggcggagtttgcagtgagccgagatcgcgcccctgcactccaacctgggcgacagagcgaaactctgtctcaaaaacaaaaaaaaagaaaaaaactttcaggatctaggactaggtcaggagttcttgagcttgacatgaaaagtatgattcataaaaggcacaactcataacctggacttcatcaacattaaagtcttttgctttgtgcaagatcctgttaagaggatgaaaaaaagaactacagactgggagaaatatttgcaatcctcatatctagcaaaggactagtttctagagtgtataatcaactctcaaaactcagtagtcaacaaacaaaaaatggattagacgatgtctctttgtctctttgggtatctgtcttcattgcagtgaatcgtttgtatacattgttttattacagtcacaaaagaaatcatgtattaacaggaataaaaaagcaggttgttacctgtcactagaacaatattatcgcttctggttgccacaataaatcatattatgactttttccaaaatcctccaaccaaaggttgtccccataagcctttcgatatatattattaagatataagaagatgcttaagagacaaagagatcttccgccaaagaatcagatacctggatggcaaataaacacacaaaacgatattcgacatcacgagccattagggaaatgctgattaaaaccacaatgagatgtcactacacacccatcaggatgcttaaaaaaaataatagtgacaacctcaaatactgatgaggatgtggagaaacaaggcactcgtaaatttctggtgggagtgtaaaacggcccagccactctatgcaacagtttagcaattgctttaaaaactaagcacataggccgggaacggtggctcacgcttgcaatcccagcactttgggaggccgaggcgggaggattgcttgagcccaggagttcgagaccagcctgagcaacatggcaaaaaccctgtctctatttttactagataaaaaacgtattttaaaaaactaatcacacaatcaatccacatatgactcggcaagtgcatttgtgggaatttatcctagagaaacgaaaacttaggttccaacaaaaccccacacatgaatgttcctagtagctttattcacagtcgcccctgaatgggaagccatggttcatgtccatcagtccgtgagcgcgtggaccgtggggtgctgctactcagcagtagaaaggaacaagttcttgacacacaggacagcttggatagagcttcacaggatgatgctgaaccaaaaaaagtccatctcaaagctgacatcatgcagggttccagttacgtaaaattcttacagaggagtggttgccctgtgccagggcagcgtggaggaaccctgcggtgggggagtggttctgcgtctagctagtggtagtagttgccggaagctacatgtatcccagtggcacaggattctaaacacacaagcacagatgggtgcctgtaatacccgtgagacctgtggactgtaccaacctcaatttcctggtttggagagtgtactatgcttctatgcaggatgtcaccatggggggaagtgggtgaagggtgtatagggcctcccggtactttttttttttttgcaacttcctgtagttacttcgaaataaaaacttttaaacgtggctaatggaaaattttaaatcacagaggtggctcacgttacatttctattgggcactgttagcctaaaccgggggatccacaaaccatggcccgagggccaaattgaggctgccctctgcctctgtacagcccatgaacgaagacttttttaaatgaatagactttcttttttagagcgattttaggttcacagaaaaactgagcagagtacagcgagtttcccctcaatgtacacactttcccataccattaatgtcttgcatttgcgtggtacatttgctgtaactgatgagccaatattgatacattatcagtaataactgacgttcagggcttctactaggttcactcttggtgttgtacagtctatggggtttcagagacacagtggcaggcgtccatcattgcagcctcacacagaatagtgtcactgcagccgggcgcggtggctcacgcctgtaatcccagcactgtgggaggccaaggagggtgcatcacctgaggtcaggagttcaagatcagcctggccaacgtggtgaaaccccgtctctactgaaaatacaaaaattagctgggtgtggtggcgggagcctggaatcccagctactcaagaggctgaggcaggaaaatcgcttgaacccaggaggtggaggttgcagtgagctaagattgtgccattgcacttcagcttgggcacaaagagcaaaactctgtctcaaaaaaaaaaaaaaaaaaaaaagacaagaaaagaaaaggaaaaagaatagtgtcgctgcctttggaatccagtatctgcccatttatctttttctcctcttgagcccccagcaggtgttgatctgtttactgtcttcacaattttgccttttccagaatgtcctagagctggaatcatgcagcttgcagccttttcagactggtgttttttgttttttttgagatagggtctcactctgtgacccaggttggagggcagtggtgcaatctaagctcactgcaacctccgcattctgggctcaagcaatcctcctgcctcagccccccaagtagctgggactacatgtgtgagccaccatgcccggctaatttttgtattattattataattttttttttttttttttgtagagacaaggtttcaccatgttgcccaggctggtctcctgagctcaagtgatcacccacctcggcctcccaaagcgctgggattacaggtgtgagccaccgcacccggcccagattggcttcttccacgtagcaatgtacatttcagcatcctccacatctgctcaaggcttgacagctcatttccttttatccataaacaatattcccttgcagggaagcgccaccgttcgcacatccacccaccaccacagggtatcctgactgcttccaccgcgcccgtatgaatgaagtggttacaaacacctgcgtgcaggtttcatgtgaaggatggttttgaacatttttaaatgttgaaaaaaatccagaggagaatatttcacaacacatgaaaattatatgaaattccactttcagtatccttaataaaacgtgaatggggctgggcgcggtggctcacgcctgtaaccccagcactctgggaggccgaggcggggggattacctgaggtcaggaatttgagaccagcccggccaacacggcgaaaccccatctctagtaaaaatacaaaaattagccgtgtgtggtggtgggcacctgtagtcccagctactcgggaggctgaggcaggagaattgctttaactcaggaggtggaggttgcagtgagccaagatcacaccactgcactccagcctgggcgagagagtgagacactgtctcaaaaaaaaaaaaaattaatggaacacagccatgccaattaacatacattgtgtggtggcttccatgctacaagggcagaattgaaaagctgcagccaaaaccatctggcccccaaagcagaaaatacttgctgtctggcccacctgccaacccctggaatagacaattacaattcccaactttgaaagtccaggaagaaaaccaaccaaaatgataacggcaacaccagagggatcaaagatcacaaatatttcccttctgcctttcccccaaatttctttttttttttttttttttttttttttgagatggagtctcactctgttgcccaggctggagtgcagtggcgtgatctcggctcactgcaacctccgcttcctgggttcaagtgattctcctgcctcagcctcccgagtagctggaattacaggcatccaccaccacgcctggctaattttagtactttttagtagagacggggtttcactatgttggccaggctggtctcgaactcctgacctcaggtgatccgcccgccttgggctctcaaagtgctgggattacagacctgagccaccaggcctggccaccctcgaatttctaaaatgaacacaatctcttttgtctctttggaagcccatttctatagtgtctttgccggggccccagcaacctgtctgggactcctgaccagactcactcgctcagctctaggggtcgacgaggctgggccatgaggagcaactgacatgacagaaacaaggagtttctcagggccctgattgtgtttggttttttgctttttgtttttaaccagagtcactgctcagccatcacttgtgctgaaggcttgagctctgcgtcaccctttcctaaaacggggtgatgaccacactgatgtcgggagctgtttctgggattcaggttggcacccatagagcatatgccgcggtgaacagtgctcccccaagattcatgtccacacagaagctcccaatgtgaccttattcagaaatagggtctcagcagatgtcaccaagctaagatgaggtcaccctagatttgagtaggccctatctaatgactggcatccgtatgagaagaagagagggcacacaaagggacacaccctgtccatgtggcaacagaggcaggggtcggaatgatgtggccacaagccaaggaatgcctgcagccactcaaaccggaagagaccaggaaggaccctcccctagaccttccagagggagcgtggctctgcagacaccttgattttggacctctggctccaggactgtgagagaatacatttctcttgtttcaagcacccggtttgtggtcctttgtcacagcagccccaggacactgatacgagcacgtccaacggggctggcaactcagtcaggtacacagtgatgatgactgtctatctgccctgtactgagccctctgtgcagagctttacacgcacggccttcctgaacccccacaatgcccccacttcacagaggagtaaactgaggtacagagtggttcaacaccgtccaaggccaccccctgcgggtcttgagtggagcttggattcacagctgggtctctgaccaaagctcacttacaggcctcacccaaccaagcccgccagccccttctctgcctagacatcatgtgtgagccaaacagccatgccacagttgcacaccagagggctgggcacggtggcatcccagtcgaattctttggcagcccctccaagctcccagagctgaggggcagccagggaggggaccagtgctcggctgggcgcctgcttggcttctccgcctgacagtgagactgctggggcgaggctatgtcctgtggccatttctagactgactatggccacatgccagttcatggggctctgaccagccagctgcccttcccgtaacagcttccctcagacccctggcatcggccactctctgggtgcaggcggagcagctggtggtggccaccttggcttgggcaggggggagtctgggggagggaggaacgccacacagagcctgccaagtgctacagaaacaagacgagattagtctgaacgacacacagaacagattgcagggtgtcgggcaatgggatgttttaaagaaataaatctcagctcccggttacagaagcacaaacaaacccaaacaacagaccttcaggagctgctggcttcccggctgccaggctgcgctgggcccggaggggtgggcgggggttcctggagcatcctcagggggcggcgggcgctctcggggtatccccgggcgccctggttggcccacgaccgggatcaggggtttgatcctgaaatttgggaggaatggaggatgcagccctcccagctcctggccatcccacctccgaggtctctctgggacccagttgtccctcccctgggtggcggcagctcctggatatctgtgctgcacctgcccctggtccctgctgctgctggagtggcccctaagacacgcacggcccaccctccccactcaccccttgcccccttccctgctgtctcttgccctggaccctctcacatgcccttccctccaccccccgcctcctgctcccttcctcatcccctgctttgtgtccccgtctcctgctccaggctctgatttgctgggcagctgctgcgccccggaacaaagacgggaagggcaaagtgtgtcctgattcgtgtgccaccgctcacttcttcgcccacctccaggagtttctaatcctcctcgggcttgcctggagggttgggcagaaaaggaacggcaggaaacgcagaagggatccggaacgagcagagctttgtgagtccagggcgacacccccagggccttccgtgggagctcctgcaaggatgcttcccagcactgggtcctggcccaccaagcgcactggctctagctcattctcagagactggactcttccccgagagcctcatttctgtcctctgtgccgtgtaggaggacaggggccattacaccaacgatgaacgataacgccgttaataattcagccgctgccgctgatactcggtcgacaaggagccttttcctcctaaaggcagaaagcacttagatgccgtttattactgcctcgcacgccctgcggggtgggctggcacctgccagggaagccatgtgaggtggggagcggccgccccatggggtctgctgtccaagcactggccagctccaggtgaacccttgtgccatcgcccccatgacaggggccaccctgagggagtagaggggccttgtcttatcatctcgtctttcccccattactttggacagagagtttttcgggcctgtcctgctgggagggtcgctacgtttctagggtccaccttccatcctcccaggaacattccgtccagacctgtgctgtcaggcatggaggcctcccgctgtgaccaccaaacttcacattcattgaagataaagaaagaccaaagtccagttgcttggccacatctgctgcatttctagggcgtggtggccacacacagtggggcacaggcacaggaccgcgtgcactgcaggacgctctgctgacggcgctggcccaggcactgggaggaccctgtgaggaagcacccgggaacggtggcgcacgtagggaacaccacgcggccttgataggagctctccagagagaaagctcaggtcccagcaggggtcacggagaagaaagtctcttccacctgcaggtgggctggggattcagcaggagagaggagaacattccagctgcgggcagcaaggtgggaagcggctatgcttggggtgaagtgcccagtgtgtgtgcaggaaagggcaagaggaaagtgggagggcagggggtcccggcagcacccccaggtgggcagcacattgctcctggcccttgcccacctgtggccgcgccaacccgcttggactgagtctgacctggcaggaactgcatgacagaaaccacagtaacaagtggccaaactctgaggccaggccacccagcccatcccaacacccaaacaccatcttgcctaggctggccaccccgggaacgcatgccgggaatgacaagaggacccagggagagagagaacgaaacactcacttccccagggggaggccccgctggcggcacgggacccaaggtggcaggccggcggcactggtgtcactggaaggacctcagtgaccagctcgccctggaggcctcttcactagttagcagcgtgcagcgcagtgggagatgcttagcgtccccaaatgtgcaggttctccccttctgtctatttttatacattggttttcattctaagcttaatataatcacagaataacatttttgaaaacagaaaagtaaaaaaaaaaaaaaagtgctcataatcacactaggctaacacgtgggcacaccttcctctcaacctctgccatccactgccgtggccactgaccacaggcgctatccacatttatattcatcagggccgggcacgcggctcatgcctgtaatcccagcactttgggaggtccaggcaggagggtcacttgagcctaggagtttgagaccagcctaggcaacagagcaagagtctgtctctaaaaaataaaataaatgaacggggcatggtggtgcatgtctgcaatcccagctacttgagaggctgaggtgggaggatcgctcgagcccgggaggtggaggctgcagtgagctgtgattgtgctgccgccaccgtatgccggcctgagcaatacggtgagactctgtctctaaaaacgaaacttaaaaacattttaaaattaaaaacaattttattaatccgtattatgtaaaattaaaaattcagttgcacttgcgccatttcaagggttcaagagctgcatgaagccagtggccgcagtgcgggacggcgcagacctgggttctgtctgccctggcagaagctctgctgggcagccctgccctgagagcctcatctgcacctcaggcctcttcacagagtttaactgcaacgggcagaatcataacccgtttcctgctttgcgtctgattcactctaaatttccacactgcaacactgcatggaccatttgacagtccttgtcaataccacatcttctcctatctggcagcaccgagcttctgaacgttttacaggtcacagaccttctgggaagtcagatggtgcctcctcctcatataaaaaaaagtggggtaagatctcaggggttcgtgagcccaggtttgaaaactccctgatccaacagagggaccttagagggaccttagtcggtccacctcctctgccgttggattcttatgttctgctcctttttccccactgtaaggaataccacgatgaacatcttcatgcagaagcgtttgtctttctacttttattttcttttgagacaaggtctagctctgtcacccaggctggagtgcaggggcaccatctcggctcactgcaacctctgcctcccaagttcaagcgattctcgtgcctgagcttcccaagtagctgggattacaggcatgtgccaccatgctgaactaatttttgtatttttagttgagatggggttttacggtgttgaccacgctggcctccaactgccaacctcaagtgatctgcccaccttagcctcccaaagcgctggaattacaggcttaagccacgtgccggccactttggcctttctatctgtaatttggattctttcttaggatgaggtccagaggagacattttcacttagggagcagaatctggtgtttttgttgttcttgtttttgttgttgttgtttttgtttttgacaaggtctcactctgtcacccaggcttgagtgcactggtgcgatcatggctcactgcagcctccacctcccaggctcaagcagtcctcctgcctcagcctccggagtagcagcttggattaaaggtgtgcaccaccacacccagctaatttttttttctttttggtagagacggggtctcgctatgttgcccaggcttgtttcagttctttatccaggtcaccaatgcacatccccggggcagggtcagtggacacggtaccagccccatggcgccccgttattccacaccctcgcccaactggccttttaggctggacggtagcttccagcacagaaaccaagggcaggatgaccagtcgcgcttggtggtcaccctccccagcacacccgagagccttgctttctgacactgaggagggcacaggaccaagatagcccagggctcacccccggctcggggaagctcagggtcttggggtctcagggcggggaggcaggacgacgcattggcgacagcagctctccgtatcaccccatcccccaagtcagcctcgaatactcacttggtcaaggatttccaggccgtcgctggactggggcctggggcctggggcttccaaaggagacctctgggtttagtaggtgggctcaccttccagcatgcagaccccacctggccatactctacaggtagcacacgaatgtgggcagcccgggggatactgccatttctaacccctaagctcttctgtgaactacttgccaaataaccatatacctgggggaccctaggcccccggggtggggtgggggagttgtccctcctggccaatctcagccagacacgcagcctgcacatgcagttcttcagatccaccactagaggggaccctcgagccagcctacctgctctgccctccggggggactcaactccgggttaattattaatagacgccccaccgctcagagtggcgatgggtgcacccgagtcctcaccaacacccctgcctggcgggatggccagtcatctggggtcctcggccctgacacccctccccaccccagagcaccaggagcgctctcgctctctctcgctctctcgctctctttctctctttctttctctctctctctctctctctcagccccttcacagcaggggttctcaacgctacgtgcacttcagaaacccccaggaagttcaaaacattcccatgcctgggcgccaccccagcgatcctagtttaattggtctgggtgcagcctgggcatcaggatttttaaagctgcccagggcattctcatgggcagccgggctggggacgcctgctctacagcgtctaggacaattaaccaccttagccaaggatctccagtcccatcatacgaaggccccgggggatggggatggggcaaggagcaccacctctgcttcctgggtctaccatgtggtgggggccagaagcgcacaggagcaaggaaagaccagggaaatgcagattccagggctcgcccagcccctttcagaatccatgtctgcttttctttttctttctttctttttttttttccagacagagtatctctctgtcacccaggctggagtgcagtggcatgatcacagctcactgcagccttcacctcccaggcttaagccatcctcctgcctcagcctcctgagtagctgggaccataggcatgcaccactatgcccagctaatttttatgtattttttatagagatgaggttttgccattttccccaggctggtcttgaactcctaggctcaagcaatccacccaccttggcctcccaaagtgctgggattacaggcgtgagtcacagtgcccggcctccatatctactttttaaaaataaaaagaaagctctcagcagtctgtcttggagacaggctgttttcactccagccttgcactgaagcacacgcttctggcggggtggggagagtcccatccacatccacctcgtcccagcacaaagctgcaactcgccacgttcagcgagcctcccctggaccgggctgacacaggcctgaggtgcgagccacaccgagcccgcggccatgtggccaagaggcattttctgagccttcatcaggagcagggccgggctgtggtaagcaccccccagcacggtctccgggtggggacgagtcccaggccaggctcgctgaccccataccccaggctggtgctcaaccctcacgccgactctgccctacaagggggttcttggccgcacttcacacccgtgaggcatctgcgttttggatgtgggaggtaatggccacaagatcacacataactcaggatgatgccaggactggaaacagatctgtcggaccccaaaatttactccttcaccaccatctgcctcccagcagctggggacggacaggcggacagggtgtctcagtggggactcgagtgtcagagcagagaagggggccatggggagggccctcctcagcccagggttcgggggaatagagaagcctcccccaaaagctgacatgaaggtgcctcgccccaggagctgagtctcaaacatataagctggccggttaggagagaggggaaggaggaagcctaggtagaggggatccctagccaaaggcatgaggcagagagagccccacaagatctagaggcagagaggacgacgaacttggaggtgtgcacagtggggggtggggaggcaggcagcatcgctcagcagggccagatggtgatgggccttggaccccgagtgaaggagatggtgcttcatcctgaaaatgatgggcggcccccggtgggtcccaggcagagggacagcctggcttccagagtgagtgcacagcacgcctgtccgctgcccactgatgccaatacatccccaccctcagttgtgataaaaaaaaaaaaaaagtgtctcctggcattgccatacaccccctgggcacagactcggccccgggtgagaatcactgctctagaagaacctggagggacctgggcatcagcgtctaaaggctcccccaggaacccccacatgcagccaggttgaagaaccagcaaggcgaagggcggggaaaagcgaaccggggtgcattctcacaatacccccagaaagtggatattaccagcctcatcttacaaacagggaaaccgaggctccaagaaaagaaagaatttcccaggttcacactaaccagtgatgccaggactcaaccggcactcaactccctaactcctaaacttgagctccctacgagatggggctgcgggacagagagctgaccggccagcttctggttgtggttctgccacagaatcctcagccccaagaccgtgggccaaccccaccacctctctgagacacaactgggaccttcccctcgcctgggccctggggatgcagggacacggggacgcctgcaggttctgctgcactgttggcctggcaccaccagggggagctccgactgagtccggcctgcgggacccaggccaggaccagagttcgggccccgcctcccccacacctcctcgggttccctggcgcctgacgccacccagctcagcaagcctcctggcacctggagtcctcagttacggctcacggcttccttttatctgcactctccaataactgagatgaatgttatcggttcaccctggggctctaatggactgcatctttactggagggataaaatcagggaagaacccgtcccacagtcacccctgctgaggccagcaaagcctgtgtccttacttcatgccccaccactccccggcttaatcggcctggggtgaccttttatgctgcagccctggggcagacccagctgggttcacatcccagcttggcccgggcactggctgggagacccctggcaagctgctgaccttctccgagccgccctttccccttcgatagcaggggataataggagggcccacctcacggggcgtggggctgtggaaagcacacacgtaccatccatagcccacggtgtccagcgcccaggcgagacccagaccacccacgtccagcatgcgcccggctcacaccacgagctcaacagttaatgacctgctcgctgactgatgtcggctcttactgttgtctgtggtcaccaccattatttgcccagaaatctaatgagcgtaaggaccacagccggggcataggaaggggctgtggaagtcggatgcaggccccctgtgctggctctggggctccgggcttatgcgaccacacgggcactcaccccaaggccatgagggccctcgtggcaccatgcaaccctccccactcaggaaggtctctttgggttccaaggcccagggaacccaccgcagggcacgggcccaactctagctcctgcaagtgtggccagcaaggagtccagatactctggctggactccccagggtgcatagcggctgccaagtcgggtgaatatggtcaacactgccccgggactacatccatcctccacagctatgagaaagagggaggctgaagcctccggggaccacagggggccaggtcacgtgcccagtgggctgcagggcagagcggggagctggagaccagcacatctgggcttgggccagccctgtgcgtgagcctaatgatgccacccgggcctcttgggcactcgcttggggactgaaaatctcctgcccctccggtgatgggaacagaagggaccaggactcccgggggcttagccttggtcatgggcccatcagacctggtagggcctgtttagtcctagtgagtctcaaggagagagaagaatgtggacaccccgacgcacccttcacagtcctctcagtggggtgtaaagtggggactccctgctgaagcccttgcctcagggaggggctcctgccacagccacggccacagccgcgggcaggtcgggcagatgcctccagcgctcacctggcatcacaggtgacgcaggtgagtgcttcctgcccaggtcaggccttgggggcctcccgagagcccacgcccagaaccaggaactcacctgctgtcactttccagaaacacggagccgcggctctcggccagcgccgcgctgatgggcgagaggcagaagggcgaggagaaggtgtctgagtctgagtcaaaggagctgtctctgctcacgccctcggctgacagttccaaagagccatcctcctccccggcctcgggccgcggctcccgcccctcctcggtgacatcctgcggactgaccgtcgacaagatcccggaggggctgcaagcaggctgcgaggctggctgggcaccatccacccccaagccctgcgccagcttctcctcatcctctggcgcagggctggcgagcatgcggtctggaacactctgggccaccaccaggatgtcctcatctttgggggtcagggtaggccgcagctccgtcggggagggctggtgggaggctcctgagctccgggtgcgccggccccgagggcggggtgccttgcgaacgggggagctctcgggtgtgatgtagcgcagggcctcctcgtcctgcctctggatgcgagagttggggacccatgccaggatgagggtggctcccagcatctcatccttctccatgtacaagcacaggtaacctgtgaggagccagggggatggcacgttagaggccaggaggctgtggatgaggcccttgtggtacctttggcgagctgctcggagaggccactgccctttagtaaagtgccagtccggcctcagatacagcctggccctgagcaaaaacactagagggaaactgtggagcttgaaatgaattccagctatgcgtgttttttaagaacacacacttccggcagatccagggggcactggtccccaagcaccggcctgccatgcgcctttctttttggtttttgggtttgtttcttttttctttgagacagggtctcgctctgtgtctcaagctggagtgcagtggcacaatctcagcttactgcaacccccacctcctaggctcaagcaatcctcccacctcagctcccgagtagctgggactacaggtgcacaccaccacacccagctaatttttttttttttttttttggtagaaataaggtttcactatgttgcccaggctagtctcaaacgcctgagctcaagcgaaccgcccacctcagcctcccaaagtgctaggattacaggcgatgagccacgaactcaggcttgccatgcacctttccaagtacaccaggggctctccctgtgttcagagccctgaccctggccccagggctcacctgcctgcagcctccctgtctgtgtgagcccagcggcccaggtgcccagcttcatggctttacagcactgttaggagggatggaggctggagacttcattctgtttcacaaaaagaattcatacagccaggcgtgatggctcacgcctgtaatcccagcactttgggaggccaaggcgggtggatcacgaggtcaggagatcgagaccatcgtggctaacatggtgaaaccctgtctctactaaatgtacaaaaaattagccgggcgtgatggtgggcgcctgtagtcccagctacttgggaggctgaggcaggagaatggcgtgaacccaggagacggagcttgcagtgagccgagattgcaccactgcactccagcctggatgacagagcgagactccgtctcaaaaaaaaaaaaaaaattcatccaagctgggtggtatttgggccttttccaatcatcagtggcactcatggcatttttttaatgcagattgtttgaggaaggggccacctttgcagatgagcattgatgtcacacacggggttgctggtgacatgggaggagggatttctcctgggccagagcaagtgggtgggtgctcagttctggggggaggtggcatttcctaacccagcaccacgcagtttcaggatatcctgattcctgggcctcccccacccactctccaggcctctacaactcagacccctagaatctcctaagcactgctcctgttgccaaaacaggctgggaaatttggggaatgtcagccagctgggcattaggataacatgagcctgaggctgagaagtgtttccacatcctttgagatcggcaagagggtccgaggtggctactccctggtctctctctctagaacaccctcaggccaggcaacctccgggtcgaggggccgcatcgcccagaacctgcacccctttctagggcactccagggaagcccctgcccacacagccgcagccaaccagccggtggctataaagatacacttatcaaggcagggggacagaacactctctttaaatgtttcattggcataatttaaacttttgtcttgtttaaaaatttatttattcagtattcgattgaaacataatctgcataaagtgcccagatctcactgtaatttataacttttttttttttaatagagatgaaatctaactctgttgcccaggctggtctcaaactcctgggttcaagcaatcctcccacctcagcctcccaaagtgctgggattataggtgtgaaccacctcgcccagatgacaactttactattttgccatcttgtctgggacttctgtctgtactcttgcccaagccaagcaaatgttagggtgtgccggggcaggccacagccaggctgcaggacactggggccctgaaacatccttttagcagccagggaaggggacggcaacaggaagaaatgagaagagagagtccagagactgccctgcagccccacctccaccacacactggcactgtgcagccgagagtcgctcagcctctctgaacaccagcgtccttacccacctaagaggcctgctggggccctggccactcccatgaggttgttgtgcaaattaaataaagcaacagatgaacaaagcaatgcatttatttgttgcaagtcattcacacgaatgacaaggggccaggcaggcctgagggatcactaacccatcttttgtccctccctttggaagcagcagggctgagggactcacccagcctgccatgagccagacttaacaccccccagaccctccttccgggaggacagctgctgttagttacacgttctggaagaggaaccaaatgcactctcacgtgctgtggcccagggcctttagagccctggctcggaaaataacctgggctgtgcgaccctggagcctcgcctgccctggctcacctgggtggtgctcccccagcccctgcagcccctccggcgggtgcacgcagacattgttcttggagtagatgatctctccatccaggacagagggggacccgctgccgctgccaccgggggtgagggtcaggaggtccgaggctttggaggaggccctgcgaaggaggcggcccagagacattgccgggcaagtgtttccatcctccgcatgcgtcggcccgggcagggctcgtcaagacctgcctgggggaggaagagagaggagatggtcaaggttgtggacttgcgttctgtctcacagcagtacgtgtcgcctcggcacccggtgggttctggttaaccacaggagcgtgtcctgctggtgaacagctctgtacagggtaggccacgttctccatcttggccaggccaccctgtccatcgcaggaggctgagcagcgtccctcgcctcaacctgtggatgccaccagcacctcccttcccagtacgaaaactagaacatctccaggctttgccaaatgtgccctggagggcaaaatccctcccaaggagaaccactaagctacagaaactctgttcccaccttagcaatttcacaaaaacctccacaaaaacgtttttttcacaaaaaaaaacgttttcttttctcagtttcccacctgcatcagcacaaatgagcccttctaattcattaaaaagaaataaacaggcaaggcgcactggctcacgcctgtaatcccagtactctgggaggctgaggcagacagatcacttgaggtaaggggttcgagaccagcctggccaacatggtgaaacatcatctctaccaaaaatacaaaaatgagccaggtgcggtggcgggcgcctacagtcccagctactcgggaggctaaggcaggtgaatcgcttgaacccaagaggcggagggtgcagtgagctgagatcacatcactgcactccagcctgggcaacagagcgagactctgtctcaaaaaaaaagaaagaaggaaaatttataaactaaaggattagtatacagaatatataaagaactcctataaattcatggtgaaaaggagcaacatctcaacagaaaaaaatgggtgctccacacaagaggaaaaccaaagaactgataaatatgtaaagagattctcagttccaaacaaaaattcaacacccaacaaaccagcaaaaagcaattttaagtcaaaaaatactgaggatgagggaaaggggagctgtcaccagtcctgtctcctccaatgcgggagcaacatggcagaatctggcaccactgagaaggcccaaagccccctgaaattcctcccttaggaaatacctgagggtggttcttcaaactgcaatttgcagccctatcatagatcctgaaatcaatttagtgggtcaacaccagcataagaagaaaaaaagaaaaaaaaaatagaaaatgcccttgaaccctggccataggtaggctcagcactgggtcagagaacttctgccccgtgaggacacattcatgtgggtaagacgacctgggacgtatgaaatgtatatataatgcgctgtgacctgaaacatgtgatgactctgcctggaggaacccaaggaaacacctaatcaaatgctttgcagccagtttctaccaacaaaaatgaaaccaccaaacctctagatagcagatgagaaccaactagacttctatacacacatggagctcacaaacacacacaccaagccacgccaaggaacgaccgtgtcagtgaagaggcaggcacagctgggcacaatgactcatgcctgtaatccaagcactttggggggccgaggcaggtggatcacctgaggtcaggagttcgagaccagcctggccaacatggcaaaaccccgtcttgactaaaaatagaaaaaaaagttagccgggtgtggtggcacgagcctataatcccagctactcgggagggtgaggcaggagaattgcttgaacccgggaggtggaggttgcagtgagctgggattgagtcactgcactccagcctgggcgacagagtgagactccgtctcaaaaaaataaaataaataaaaaaaataaaagacaggcacagagccacgctgcatcctgatcactgatgggggatgtccaggactctgaccacagctgggctgcgtgcaggccggcttcacaaaagtctgcagaggtcagggggctgggagacgacagccacagaggggcttcaccttcacctctttgaaggaagaaaagacttgaagccaacatgataagaattagcaactgggagtgaataaaccaaatgtggtacagtggaatattatttggccttaaaagaaaggaaattctgactgggagcggtggctcacacctgtaatcccagcactttgggaggccgagatgggcggatcacctgaggtcaggagttcgagatcagcctggtcaacatagcaaaaccccgcctctactaaaaatacaaaaattagccaggtgtggtggcatgtgcctgtagtcccagctacatgggaggctgaagcaggagaatcgcttaaatccaggaggtggaggtttcagtgagccgagatcacgccactgcactccagcctgggtgacagagcgagactccatctcaaaaaaaaaaaaaaaaaaaagaattagtaactgggagtggataaaccaaatgtagtataatggaatattatttggccttgaaaagaaagtctgacgcctgctacagcatggatgaaccccgaaaacattgcgctaagtgaaacaaatcagtcacaagagacaagcactgtaggattctactcgtgtgaggtccctagagcagttaggttcacagagacaggaagtggaatggtgggtgccagggggtgaggtggggggaatagggaggtcatgtttaagggggacagagcttcagcttgggaggatgaaagcgtcctggaggtggacagtggcggcggctctacaacatgatcgtactcaatgccgctgaacctgatacttaaaaatggttaaagtggtaagttttatgttatatgtattttaccacaataaaaaagttaaaaattatctattagtggagggtctccgggtatatgatcttgttctttgaactttctgcattttttacatttctccaaagatccagagctggttgagggtggtccctaaatcaagtccctttcacctccagcacttggctaggctctgggacagagggtgggtgggtgggtggaggggtccccactggctcagcagaactggctcccagcctggcaggaggcagggggcagatgtcagtggtgatggccaccatcccaggaccaggcggctcagcgctctctgcctctctgggttcctctcctctgaccccctccatgcttcagcctcccccagccctgtttgtgtatttccaattgtctccatggctgctgacttcccaagcacaatattccaaagatgttccagccagcccaggagtggccttcccattcccatgtctttcctctgacagatccatcacccccatctccccatctcagagatcccgacgtcaacatcacttgtgaaaatcaccagttctgggggtggggacccagctcagatcctcacctcctcagccttgagccacagacgccctctgcctgatctcaaccgtctccagggccctcatccactcagctctccctagcccacccctttttaggctccctcaacatgtccaatgaaggctgcagaagaaagtcgaccccttggtgcaggggtcagcaaacttgttctgcaaaaggccagagagtaaatgctttggactctctgggccggagagtctctgtcgtgaccactcaactcggcccttggagtgcaggagcagccacagacagtaaatgatgggcatgactgtgacagtgaagctttactgacagacactcaagcttaaattctagatcatttttcacgtgtctcaaaaagaattctttccatttttcaacccccttaaaaaacgtaaaaaccggccaggcgcggtggctcacgcctgtaatcttggtactttgggaggcctaggtgggcggatcacctgaggtcgggagctcgacaccagcctgaccaacatggagaaattccatctctactaaaaatacaaaattagccgggcgtgatggtgcatgcctgtgatcccagctactcgggaggctcaagcgggagaatcgcttgaacccagggggcagaggttgtggtgagcctagatcgctccattgcactccagcctgggcgacagagcaagactccatctcaaaaaaaaaaaaaaaaaaaaaaagtaaaaaccatccttagctcacaggctgtacaaaacaggtggaaggctggctttggcctgtgggttgcagatggcagtgccctggcatagaccatctgaccaaatccaggggattcttctccacctatccaaaccagctctctgccaacctctccaggaagccttctggccactcttggcctaaacacttcatcccacacaggggcatatgacaaccaagtgacgaaacttaattaaaaaaatcacactgcaaactacaaatcaaaaaacatattgtccttcccaataatcacatggaaaagctatgttctgttctaatgttatccagaatagtttaagaattcaagaattcttcaagaattgcaaggtcagttaataagccctgcaagaaaattgctcgccgtcctctagaccagccatgtccaacagaaacactgcaggagacatagatacaattttaaattttctggtaagcaaaaaaaaaaaaaaaagtgaaattaattttaataatttttagcataatatatccaaaatattattatttcagcatatagtcaatatgaaaacattatttctttattttttttttattttttgagacggagtctcactctgtagcccaggctggagtgcaacggtgcaatctcggctcactgcaagctccgcctcccaggttcacgccattctcctgcttcagcctcccgagtagctgggactacaggcgcccgccaccatgcccggctaatttttttgtatttttagtagagatggggtttcaccatgttagccaggatggtctcgatctcctgacctcgtgatccgcctgcctcggcctcccaaagtgctgggattacaggcgtgagccaccgtgcccagcctgaaaaaattattaatgaaatcttttacattctttttttttttttagagacaggttgtcacccaggctagagtgcagtggtgtgatcacagctcactgtattctgaaactcctgggctcaaggaatcctcctgcccagtctcccaaatagcctggactaaaggcacatgccaccaggtcccgctaatttttttattttttgtagagatgaggtttcacttttttgcccaggctggtcttgaacttctggcctcaagtgatcctcctgcctcagccttccaaagtgttaggattacaggcgggagccaccgcacctggcctattttatgtccttaaagtctccaaagtctgctgtgcattttgcacttaagcacgtcaaagttctgctcagccacgttttgggtgctctgtagcctgcgcggtgtccacactggacaaggccgcagcggggctggagcccacctccttctgtgtttcaaatggctctactcagtgtgatcgctccagttgccagagctggctgcacacagctctcagctgcttccccaaatcaaaaccctctttaagtgaaaatgttttgccagcactgaggataatcaaaagaatgtgctggaagctttaaaggagattccgaaatacaagtgttcaaaatacagcattttctcccataccatgacaggcagaacctcactgtggctctgcgaggtgcgtcccaacagtgcagctttacggaggagaagacaggttctgaccactcagggtcatttcgtgagcgggaaaccctgcagcgtgagaccttcgtcccccacgtgcagaactccggctcctccatcacccgccacctgggacaccaggacaacccccccccgcccctcccagattgttctggagagactgggctctttttggagaaatggagcatgtctattaaacattagacaggactgtttgctctctaaaaacaattctccttatttgtaaagtgcatttgctgtttcgcaagaggctatttcatcgaaatccaacctagttcccaacctctggtcaccagcaaactagaagtggagaatccttggcccattttttaaaacttttttttagttatgaaacacactcagagaaggaaaaggaagaatacgtgtcccttaaatcacataatcctaagacatttatgtattctctactatattttgtgccctataatgaatgagttaatgaaaaacccactccttggaattatatcatatcttgctttcagttggatcataaatatattttcccaggtgaagtatacttatgatataacaaactttagggttgaagtacatcccctaaaattcctgtgttgaagtcttaaaccccagtacccaagaatgaaactgtttttgaagacagcatctttatagaggtgatcaagttaccttgaggtcaatatgactggtgtctttataaaaagaggaagttggtagcaggtgcctatatacaaggagagtgctgtgtgaatacaatgatgccacctaccagcaaggagcaggcctggagcagcccctccctcacagcctcctaaggaaacaatcctgccgacaccttgatcttagacttcctgcctccagggctgtcagagagatttctattgctcaagccacctggaccctggtactttgttagggcagccctagcaaacaaatataccacattattaacacatttaaaaagtataaggccaggtgtggtggctcacgcctgtaatcccagcactttggaagactgaggcgggcggatcacctgagatcaggagttcaagaccagcctggccaacatggtgaaatcctgtctctactaaaaaatacaaaaattagccaagcgtaggggcgggtgcctgtagtcccagctactcaggaggctgaggcaggagaactgcttgtactcaggaggtggaggttgcagtgagctgagatggcgccactgcactccagcctgggagacagagcgagactccatctcaaaacaaataaataaataaaaataaaaattataaatgccaaccctccatcttcatagaatcagccgccattgctaggcatctggcttccaactagtggctactgaaataataaactccacattttaatacataaatcttcatctgtatcctcattatttccaggattactgtttccccaggaggataaactggaccccaactcgtattgcccagtgggttccccgaaatgtaagagtgctgccagggatttaaatctccaccaggctgggaactgaaaaatggttttctgactgggcacagtggttcacacttgtaattccaacaatttgggaggctgacgtgggaggattgctcaagcccaggagctcaaaaccagcctgggcagggccgggcacggtggctcacgcctgtaatcccagcactttgggaggccaaggcgggtggatcacctgaggtcgggagttcgacaccagcctgaccaacatggagaaaccccgtgtctactaaaaatacaaaattagacaggcatggtggtgcatgcctgtaatcccagctactcgggaggctgaagcatgagaatcgcttgaactcaggtggtggaggttgcagtgagccgagatcgtgccattgcactccagcctggaaacaagagtgaaactccatctcaaaaaacaaaaacaaacaaacaaaccagcctgggcaacataacaagatcccacttctaaaaaattagctgggggtggtggtgtgtgcctgtaatcccagctactcgggaggctaaggtggatcacttgagcccaggacgtcgaggctgcattgagccatgattgcaccactgcaccccaccctgggtgacagattatcctatatttattagacatttgtgttcacttgtgaattatctgttggtgtgctttgacaatttttctgctggcgtggtggaattcttattatttttaatacagagattaagctgagatggaattttcattgatatgtaagaactctttatatagtaaagatcactacatacacaccatagacacacaccatagatacatacatcacgcaccacataccataggcacacaccataggcacactgcataaacatcacagacacacacaccacacaccacagacacacacactgcacacaccatagacacatcacacacacaaccccataggcacacaccacactctacacacacaccatagacacacacatccaccacagatgcacacataccatgacacacccaggcacacacactatgacacacacacaccatgacacacaaacacacaccatgacacacaccatgacacacacaaacacataccatgacacacatgtatttctcctaatttgttgtttgccttttatttatattacctattttgacatacggaggtttaaaacttttatgtaaattgatggtaactttttcttagtaacttcctttattacttttatacttaatataatcctttccaagctaaagatcgttaaacattggtctatattttcttctatgttcaatgaactacttttaatgtttcaaaagcctaattcaaagcatatatttacctgaaagggactcacatgttaactaaagtatcgagcagttcattgagtgtttatgttgtttttattgctaggccctgtttttattgcttactcagttatctgacaaaaacactgaaatctatgataaattaataaagctgggacgtttatttttatttatttatttatttagagacagagtttctctcttgttgcccaggctagtggagtgcagtggtgctatcttggctcactgcaacctcttcctgccaggttcaagtgattctcctgcctcagactcccgagtagctgggattacaggtgcccaccaccacgcctggctaatttttgtatttttttagtagacaccagagttcaccacgttggccaggctggtctcgaactcctgccctcaggtgatccacctgccttggcctccaaaagtgctgggattacaggcgtgagccaccacgtccggccctgtttttatttttttgaggtggagtctcacactgtcgcccaggctggagtgaaatggcacaatcttggctcactgcaacctccgcctcccaggttcaagcaattctcctgcctcagcctcccatgtagctaggattacaggcacctgccattacacctggctaatttttgtatttttagtagagacggttttgccatgttggccaggctggtgtcaaactcctgacctcaggtgatccgcccgcctcaacctcccaaagtgctgggattacaggcgtgagccaccatgactggccggggacatttattatataaaactttatggacaattttaagaggtgccttggccgtgacccggaggcctatgtggtttggcccacctcatggtccacaccctctcagctgccgcaacgctgcacatgtgacaaacacgtgtgtgagatccacggttctcatactatcacacgctctggtgagagtaatggctcatcacaggcaagatttaccgcgaaatgggacaggcggggtcattttaacttcctccccaggccaccccctccaccctgctgaaagcacctgcaataaaatacgttttcagaaattcaccagatgtcccttccaaagatcaagcccagctgctcccctcccctttatgggcaggcggccctccaggggtattgcgaacgggctccagcgacagctgctcggaggctaccatgggacagtacccgggcagccacagccctccatgccctccttccgccccgcagtcccagcatgaagccacagttccccatgagcccagggcaagctcgtcagagacccttccctgcggaggcccacagcccctgcggccacttcttccccgaatctcaatcctgcttcgtgtggccactgctgaaagagacgctcagtgccacttagagcgcacagcccactggtccaggctgtgcacacccagggacccttccaggcattcctcacctcggtgcaggccaggagcgagaactgctgccgggcccccccccaccggctcagggcgtggctggggtggccctgctcctcggtggcccgcctggccccgctgtgggcttccctcccaccaccccggccacagtcacagcgggttgtgtcaggccgccctcatctcccacctcccaggcccagctggcgcctccagccctggtgtgaatttccattcagggtccaaaatccaccttggcagcgccctcattctgcagctccacggagccctccagccagagaagagaaatctgagtttaacccgatcctgtcagaagagcgggaggaaagagctccggcggacagggctcccaggcccctccaggacgaggttggaggaccaagcgcagaaggtaaggacgcagccctcggcgagtgcgggcggggcccaaatccctcgccggccggctaagcagaagcggcttttggctttccgcgacaaagcgcagctccgggccagacggtcctgcccggccctacccgcagccccggccccaaccagaggccccacttcagcccaccaggcaggactgcagcggggcacgccccacggaccccagccccttggagatcccaaaccccatgcctgctgctcccaccccggaggagtcagaggccgagaagcacacacaccatagaccccacaccacgcacaccatagacacacataccacacaccacacaccataccacacacaacacacaccacagacacacacaccatacaccatagacacacataccacacacaccatagacacacacactacacatcatagacacacacaccacacacaccatagacacacacaccacacaccatagacacacaccacacgcaccatagacaaaccacgcacaccatgcacacaccacacaccatatacacacacaccacacacgacacaccataggcacacacaccacacaccacacaccatagacacacacaccacacaccataagcacacacaccacacacaccatagacatacacaccatagacacacagacacacatgccatagacacacatgccacacacgacacaccatagtcacaccacacatacaccagacaccaagacacacacactacatacacaccatagacacacatacctaccacacactacaaaccataggcacatacaccatagacacacgcactacatacacaccgtagacacacaccacagatacatacatcacacaccacataccataggcacactgcataaacatcacacacacaccacacaccatagacacacacaccacacacaccatagacacaccacacacacaaccccgtaggcacacaccacactctacacacacaccatagacacacacacacaccacagatgcacacataccatgacacaaccaggcacacacactatgacacacacacacataccatgacacacacacaccatatacacacaaacaccacagacacacacacaccataggcacacacaaacacaccaggacacacacaccatagacacacacataccatgacacacacgcaccccatgacacacaccacacacagccaccctctgctctaccagctttgcctctgttctccgacagcgccagtgttgacacgccagaggctgcctgggccccactccttcccagctgtctccaggattagggaagccccaggcggatccggggccgcaggagcctccctacccagcccccatgctggtctgtcttgggtccataaacacaagtcagccacctgtcaccgggcggcaggaagtgcaggctctgtgagctggaggagggggcgcctaggctctgagggctgaataaggggcctggcaaatgcccccggagagccctggagagttttgcagcagtcctggcacctgggcttcggggcccgcctgctgggagcagccgcctgctgggagcacctccttgctggaagcacccccctgccaggagccccccacccccacccaggagcaccctcctgctagagtgccagggagacactgctgcctaatggccaggagcttgcccagggcagtgacttctggtccacttctgtcccttggttgtgtccctaagacccagggaccctggaaggttcacctgtcggtgtcacacggttccttcttcacacagcaggaacagaggtacagagaatggcgtccaggcctccttaaggactctcaatccatgagacaggaagccccacagggaagcagtggccccccgccccctatctcctcacatacagcactctgtaccttctgctcatttttctgtaaacctaaaactgctctaaacaatgaagtccgccacgcagaaactgcacacggatgttgagagcagctttactcataactgccaacactcagaagcaaccgagatgttctccaacagctgaataaataaataaactgtgatacacctaaataatggaggattatttaatactaaaaagaaaggggcggccgggcatggtggctcacgccagtaatcctagcacttagggaggccaaggcgggtggatcacctgaggtcaagagttcacgaccagcctggtcaatatggcaaaaccccatcgctaatttaaaaatacaaaaattagccaggcatggtggcgcacgcctgtaatcccagctactcaggaggctgaggcacgagaatcacttgaacccgggaggcagaggtggcagtgagccaagattgtgccactgcactccagcctgggtgacagagggagactctctctccaaaacaaacaaacatcatcttctgggggaggggggaatctattagtttaaaataaaaagaggcttgagatcaggaagcttgcatccaaagaggtgtggaggaggcgtggacgagggtggagttgtgtggaccaatgccgagaacaggcaggcactagaggcaggctgaacagagcagagtcaaagacaacgtttggttcctggactgagaacccagctgccggcagcccaagttgtctgatgggagagtttcctaatgtccttgaatctgcaagatgcaagactttgaatggcccttgcccacagcagtgtggagcagttgatgcccatgaccttagggacctggagtcctgcggggtttgaggggggcaaagaaaaccattcgtcctgggaggcaaggaagctggatgtcaggaaggctgccccagtatggaactcagagcaagggggacatccaggttcccttctgcgggcctggggctcttcctaggggccagatgccttctcatcagtacacgaacagaggcgggggcagccagcagaactcctaagacacaaaatgagtgaacactggaaagggagctgagacaggcctgcagcaaagaacagacaccaggcttttccaatctataggaaggactcagagttcatcaaaatcaaaatagcaatgcaagatgctcaaagcaccttgtggcaattattacaaatcccctccccaaatcctgagagatgaagatggatagagaagctgaggaggctgggcacggtagctcatgtctgcaatcctaacagtttcgggagtccgaggtgggcggatcgcctgagtccaggagtttgagaccagcttgggcaacatggtgaaaccccgtctctacaaaaaagcaaaaattagctgggcatggtggcatgtgcctatagtcccagatactcagaaggctgagtcaagagaatcgcttgagcccaggagttcgagatcagcctgggggacatggagaaaccttgtctctacaaaaaaactttaaaaattagccaggcttggtggcctgtgcctatagtctcagctactcaggaggctgaggtgggaggatcgctcgaccctgggagttgaggctgcaatgagctgtacttgcgccactgcactgcagcctgggtgacagagcaagaccctgtctcaaaaaaaaaaagaggccgggtgcagtagctcatgcctgtaatcccagcactttgggaggctgaggcggcagatcgcttgaggtcaggagtttgagaccagcctggccaacatggcgaaaccccgtctctactagaaatacaaaaactagctgggcatggtggcaggcgcctgtaatcccagctacttgggaggctgaggcgggagaattgcttgaacccgggaggcagaggttgcagtgagctgagatcgcaccactgcactccagcctgggcaacacggcaagactccaactcaaaaaaaaaaaaaaaaaaaaaagagaagcagctaagggtagatccttgacaataagaaccccccattctcctcaaatgcatccacttcacatttgtattttgaaacggtgatgtccttgttggtttgtgttttcaataataagctcccgagtgcatgacacctccgagacgctccttttataatgtgcctcccagaatgccatcttcgttaaggttccaaatgccttgtttttgttgatggaaaggatagcaatgccaacttggcagttggcacaaagaattcacagatggattgaagccaagatctacaatttgcatcagcttgagtgtacaaaaaaaagaaaagaaaaaaagaatagccgggcgcagtggctcacgcctgtaatcccagcactctggaaggccgaggcagttgcatcacctgaagtcgggagttcatgaccagcctggccaacatggtaacaccctgtctattagaaatacaaaaattagctgagcatggtagcacacacctgtaatcacagttgctcgggaggctgaggcaggagaatcgcttgaacccaggaggcagaggttacagtgagccaagatggcaccattgcactccagcctgggtgacagagcgagactctatctcaaaaaagaaaaagaaaaaaaagaatgattttagaaggcaaaaagtaaaagcgtcaatgctgattctaaaccatcagaccggggcatgatgaccagttgattttttttttttttgagacagagtctcgctctgtcgcccaggctggagtgcagtggcgcaatctaaggtcactgcaatctccgcctcctgggttcaagcaattctccagagtagctggaattacaggcgcgcgccaccacacccagctaacttttgtattttttttagtatagacggggtttcaccatgtgggccaagatggtttcaatctcctgacctcgtgatccgcctacctcgacctcccaaagcgccgggattacacgcgtgagccaccgccccgagccgaccagttgatttctgtgctgctcaaagccattggtgaccagtaggtagggccagatttctgcaaaataggccattgtgtaattcgaaaggaaagaacaacttggccattcctcaacaaaaatacacaggctcataaaacaaaaaactgtgcagaaactcctccaccagagagtcattctttcccagaaacctgcaactctttaagaattagagcaccattgagaagcatggagtcgcagcacctgcagctggcaggggtgttaaactggtgataaaggtagctgaagtctgcttccaggacgagagcgctttgagggggctggagtagggggagctgcctgcaaggtgaagacgtgggaaacctcagaagccctaaggagagaggggcgggcaggggaggagaggggcagcagatctattctttcacaatgctgttgggaactggccaggctgttgggttggagctgacacagggcgcagctgtgagcctgctgttaaccacacatgttcccttcccgtcccctaggagccacttggccactgaaacttggcctggaacagccaaagatttggtgactcactgtgtgagcagtgggggtgggtcttctctagcaaatattcacagggcatgaggttaggacatctactacccaaaattcactgcccaagatttggtgacttataccctagaaaagagagtcctcctcaatgtagaaagtggcaaagtcaccagaaaaccagaaatgagcaaacacagataaagaaatgacacaaccgtctcccctcttgtctccttttgaaagccctcattccacgcgtatgagcttcctacggctgctgtgacaaatgacacaaacttaccagctacaacacaaatgcataaccttacagtcctggaggtctgaaatctggaatgggtctcacagggctaaaaccaggtatcagcagggctggttcctcctggaggctctaagggagagtctgttttcttgctttttccagcttctagaggtcacccacactccttgctctcgaccccttcctgcatcttcaaggccagcagtggccgatcgagtccttctcatacctcatctctctgaccctgactctcctgcctgatcctgcgattgcatcaggcccactcatataacccaggatcatcccccatttcaaggtcagctgctgagcaaccttaattccatccccaacttgaatccgtggccacgtaacataccatatttacaaattccctggattaggacatgggcatctttgggggccattcttctgccaaccacaccaaaccgaggacactgtaaggagctgatttccaactcgcagggcggcctctgacctgctcacccactgacggtgaaccccccacgcagagtgactactcttttagcagtaggatgaggaccgaggcctagaacccaggagaggagcacgcctgggccccgacgtccctgtgagggcagcgagaatggacacaggtgggctacaggttcatgaccaggacctgcccgtggaggctgcctccacctaaggtcttagtttcctgtcctggcctaaagggcttcatcagttcccaaacaggaaaacaaaaagaacagaggtgcaaaagtctcttccagaaccctcctggaggtagcctggagccactaggagagaggtatcaccccagcctcttctcttgctcactctgtgccgtgcaccggcctcagggccaccttgggttaggggccaggatgcagcagtcagcaggacagacctggtcctggaaacccatggagctggcagttcccactcaccagagggacgcagcccatgcccactagtgacaggcaggggcagaggcagaggcaggcagggtgtgggggccacgggacgcagcccaccaccgattattcccatggccatgtcactgccagactgctcaggagcaacacgcactgagcccggtcacctggcacatggccggcagaaactggttcatctgctttgccctcaaagcccaagcaacaaagaacagggaaacagcgacaccttattaaacacgagccagacacacgcaaacaaggatcgcgttgcccccgctgcagaacgtctgctgctggcatgccttggatgaggccccagcttcctccacctgcccagagccaggcaggggccctacccatcttcctgggaacccctggctttgcgggtcaaagggcgatatggaatcttgtaggcagccaggatcaggacccagtccccgggcagcaggcttggggaaggtagctccttcagtctcatcaggaggataatcccctgcggggccgccgtgatttctcctcgcagctgcgctgaacttcaagttacaggatgaattgagaaaataaagatactggctgcacacagaagccacattcaggatacacccggaaagcctggggcccaaagatgagcctctatgcagaagcgagaacgggacatcaagttgtatttaaaatgaagaaactagggcttagggcattcactgcagtgctgggatcttggaccatagggaaagaggacccctgagaggctataacggggcaggaccatcaccaaaacggtggtgagggaaaacctggtggcctgtgtggctgtgactctccttttgcaactgtccagcggtcaccctgattagcacccactccctggaaaaccccaaagcctctgcctccaaggagagaccatctgccatttgtgcacccttgatagtagattgtaaaatcccatttcccccgcaaagagccaaggaggtcaggcctgggagaagaaactcaactcagaggtgagcctggatctgggactaaggaaagactaaacacaaagggtaagggaagatgcagacccagccaggaaatcaaaaactgccctgagtctggctcaggtacctcctacttctatgctgtgcctgtaaacatggaggcctaaagcttctcagcatctgtcagtgaaggagcagtgaatgcaccgcaaaacaaaactgaaactggggggacatattaacaacacccaaaagcaacacaactgatcttgctttggaaagcattttagttacagaaaaggcaaaaggctgtcaaatgacatctgtaaagttcaccctttcccccacttccagaaggctagagtaatgatgaactatattggagcattgaattcaggctcactcaacatgcaaaaagcagtacacgactgaagtgtgcaagccagcatggatgcgggcttggcacccgcagtacgttggcttcatagtgaccaatccagaaagaccacggagaaaatactgccacatctcagcgtctgcagcccatacaggcaagcagacacatgtatcaccttccaacgcctgcacagactcaccgcccaaggctcagcaacagaagggcaggccattccgactggacagtggatttggattatttctcttttctttctgttattcatgtgtcagaagccaccacgggcagaaatcgaacttagtcttacagtggcccgatttctctcatcctttgaggatggttatgtaagttccgaagacagagtaaagaacgtatttcaaatcagatgccaccagacagctcataaaagcagatttattagagatgcaacatcaggtgctcaaaggacagataggataaaaacaccaacaaagccaacaggataaaaaacactgccgctgaggtgaacggaaaaaggcctccaacatcattgccccatatttttgggaagggtgcaaatgtgtgctctctcctgtgcactggcctcattaacagcaatataatgcaaatgcaatacaaatggtgtacaattcgatcataaaatcatcctctgcgctgtcaccttcacatcccagagccacccgcccccggtgcttaatgctggatgaaacaaagtagctaatcttacaagagaatttaggcctgtgacaaaaatcagggtccctcagccagggaagaaggggagctaaaattttcacaggaggtggtgttgccaggcaacctgatcagctctgctccccatagcatcctgcagggacccagcccccggtcaagttgtaaagataagggtacacatacgcacaaatagtaaatcctacatctgcctggaatcactttccacctcatggaccacacaaaggggagtgaggagtcaaagcacaaaaacaaaatgttttgtgtcaatctagttaaatgtggaaaatccaaataacggtcattaataacagtgttaaaatgttaccatttgacattacttaccacatcctaaatggtaactcaggatgtgtcaggaattcaatgcttttcataatccttgcacaaagtctctgaagtaggtagtatagatggggaaattaaggcactggagaattaactaagtgccagaggagttggggtttttgttgttgttttgttgttgttgttgtttgggttttttaggttttttttttaagcagagtctcactctgtcacccaggctagaatgcagaggctggtcatggctcactgcagccctgacctcccgggctcaagctatcctcccacctcagccacccaaatagctgggaccataggtgcccaccagcatgtccagctaatttgttcattttttgtagcgatagggtctctctaggttgcctaaggtggtcttgaacttctgggctcaagtgattctcccaaaatacaggattataggtgtgagctactatgcccagtccaggatttgtatttgaagccagcagtccatctttctacgccatgttcttaaccactgcaccttattacccaaaactgtggacagagaccagtgcaattgtaggtaggttctgcaaactcaatggctttatcctgaagcctgggggatgctttccatactgaagtgaactgagattagcagctagtggtgacatgggattagtcccacctccttgcactgttatgaaccacttggaagaatgtttgtatatgaatggtgggcaccctctgtaagacagagggcaaagttgtacaacggttttctggagctgggacgtcctgggcctaaggcctaattctgtcactcctaactgcatgagcttgggaagttacttctctaagcgtcagtgttcccatctgtaaatgggcataactgcagtcctgacttcatgagcttgttttgtgggttaagtgaattcatgcatgataattaggaactactaacgcaatcaccaaaattgctagaggattaaataattccacagataaaaactttttttttcctttttttttttttttttgagacatagaatgttgctctatcacccgggctggggtgcagttgcacatcttggctcactgcaaccttcgcctcccgagctcaagcgattcccctgtctcagcctcctgagtactgggattacaggctcacgccaccacaccgggctaatttttgtatttttagtagatatggggggtttcaccatattggccaggctggtctcgaactcctgacctcaggtgatccgctcgcctcgtcctcccaaagtgctgggattacagccgtgagccacggcgcccagccataaaaactttcgccataaaaactttcgttagccatagtctcaccataaacatgccacttacaaaaaaatatgcgcacaataaccacgctcaggatgcaaacaacatccattaatgaactttgtagttaataccaaaagttactcctcactttattctttatttacaaaagctttcatggttcttaaaagtgtttagtattcaccaattttactgttagcgtttctaatgaggattttctaaaactgaggcatggatttgaaaaagtgttctgatcaatcagtaacagatttggaatggaatctccagcccccagtctttgcgcccaccctctggcaatatgccgcctcacgtgagcatctttaagacggagttccctttttattccagataaaagaattaggagccttctggtagaaaagaaagcagatcttcaggatcaagtcgcagaggctggccaatcagcccagcttctcatttgaacttgacccagacagtaaaacaaactttaccataaggcgagactaacttttgttatgtcttttctattcatttcctatttctgaatcaaatctgaactactttgtggccaatatacgacaccagcttccgagtgtgggaatcacaggatttcaggattcagcggcttccggcaggatcccctaggttatgtttagcaatcttcagttgcctttcctttttttctttccttcctttcgttctttctttctttttctttttttttttttcccaaaggaaagaacaagggagcccaggcggaacggaagtgagtatcccgacacgcggatcttaaacagcccagaccaccaagcccgacaggccgggaaagctgagcgcgcgctgctggggggacgcacactttggaggctgtgtgggcgcgcgccggcaccccacaagttctcatccgtctgctccgccgattcagccagacaaagaccgcaagttccccggtccaccgctccagacaggcggggaccagtctccccgaattaggcccattccgggcccgggcgccctcactcgccgcggggaaaagtccccaggtgcccctccgtgatccaggtcctcccacaacgctcccgctcctgctggcgccccgcaccccgaggacggcggccggaccccggcccctccccggtcccgcggctgcaggcccacgcgccccacgcgccccgcgcgcccccgccccagctccgccgagggggcgctgctcgctgcgcggtggacccctcggaccccgcccccgcggccccgtccgggccccgatacccacccgggtcccgctgcgggggccggattcgcgccggctccgagagccgccaccgtcgcctccgccg

SEQ ID NO: 382 - DNA, 18515 bp, Homo sapiens
  source 1..18515: mol_type = genomic DNA
tgacacttattatccttcagtctttattttaaataaggcccctgtcctttaccctcccaaagtacttttagacattttccttctgcccagaatcctctgcccggtcccctgtagctagtgtccagacactggtcacagacctccactgagcccagttagagcgctgacctcccatctcaggacttcttggcccttgcccattgccatactctactgtcagattttaaaactgctagaccatgtgccaattcacattgacttgtagccactaggaccctgtgtctttttctattgtgcttgttcatggccaggaatcaacgaactttggacagacaatcagtagactttgggtgtggccttggtgaaggcttcccactttggtgacttgcatgtgcccctctttgttgagggggttttgaagcagcttctgcgtcattgggagctggctgctgcgcccagcctgaggccctggaccccttttgcaccatcctaatttcaacatccagatgtcaattcagaaaattattatatcattctaatgactcaaaacataaaatcccctcttttgtctcatgttgaagagctgatgacatcggacctatcaggtcagacttattttcctagtcagagactgaatggcatattttcaaagcacttcgtctaaattgcatggcacacaccccaggagcccaaagatctggttgttctcttgagatgcagagaggaggcccacaggtggcggaggggtgaaggaggaggagccaccacttccgaagcatcagaatgtcaaaatctaagttttccacgaggtcagcagcaggtgtctcctggtctggagagggcatggaagtggccacaggtctggacttctctgggtggatgtgagggagggtgattgaactggaggagggggctggcttgagaccttcctgttctatgttgggggggatactgagggtccgtctcactgggacgaagagggggcacagatgcaggtatgcccaggtacctgagtcccagccaaagcggcaaagccagacctcccgggattccttgagtttggacaaagggtgtcccgacgacgataaagagccaggagcagagagccctgcatcttgcctggggccccttgtatctctggctcatggcctgtcctgggcacggggaggaagggagacacccgtaataataacagagaccgcactggactatgggggatcacaatgggtttcagtttgattgagagaaaataaggtaagggacacgtgctcgcctgagtctctggagtaagagtcacgccttggagaaggagggcagccaaaggccacgcagaaattgggggttcaaggtttgcccagccggccccaaaggtgtgggggtccacatggcctcacccaggggccagtggggtggctttgctcatttgagggtgtgcagggtacatatgtgtctgccccgggaatccaagtagccccagtgcgctcctgccttgcttccctagagcgagcccacggtaccatagtcctcgtgggatgaatgcatgaatgatgtggaaggagccagaacagggctgcagacaggatgctctctcatagaaggaccccagagaacttcccctctggagcctgtgcggctggttgagtgtaaacgctgagtcatgctcgctgcccagctgtgtggcaagggcactccctaggcactgagcagccaccgccagccctgagggctgcgggacaacagagagccgggcctgcccgaggcacggcccctgaaaagtgtggcccgccaggtggcacctatgttctcttgcccggcgtgggtgactacacagttgtcatttacgggggaagtagggcacagcagaggtgaacatgaggatgatgctgcgtctgggctgtatccagggaaccagctgccggacaaattggaagggaccttcttggcaggacaggtccagttggtggcctgaggtggggttgtggtgggccttgtccccctgcagggctgacccgtgcaggtgggatcatccttcctgaggagctgccctgcccagtcccgttgccttggaggcggtgacatcaggggcccctgagccaccaggttcctccatcttcatgtggccaccacggctgttgcagagtccacggtaagagccaggacgtggcttccaggcaggatggggaagcacctcccactcccacatggacaaagatttctttaaacggagccaccagccatgcctggtagtgggtgccctccctaggcaggcagtgctggctctgctctttcctgggggaagcccactgctcctcctggggcctagtccgtgggacctgcccagccagccttgggaggggcacccctgggcatgtggagaggaggtgatgaggcgctcagatgtcgaggccaaggccaggtaggtggcaggtgagacaggcccttcagacatgagacccgagtgatgtagataagaggtatgttcccctccagcccccgcccccaggcaaaaggggaaaagacacacagagaacaacagaaaacagttggaaaccccaaagggcgcttgatgaagagctggagctccccgccccccgtgctccgggaggaccaggagacctgctccatgggccaaaccgcctttgcccatccctcccctgacccctgctgcacggttccaagggcttggtagggcagcctgaattttccctaactcccactcctaggaaggtcaaattcaccttgtttgcctccttaaaaattcacaaatgcaggactgaggcttttcctgaaaccagagccccggcagccaaggctcaataaaatactgtttgtgtttccaggcactggggtgggagcgaggctcccagttgctcagagttaaccggccctttcccgagtgagaccccgcgagcactcgtcaattctcccatcaccctccatcgccgcctgctgggggggcctgaggtccggagctgctcttcctcctggcagcccagcctgcaggcctagtgctgtccaaccacagcccagagggcaaggcctcccaaagtgggcgcttgctgagcccctggccagcctcccaggaccctcagtccccacagcccccatccagctctcttttacaccttcccctcccccatctcagaacatgggagaagccgggcacactggcgtctgcaggctgcccttgggctgccacggggccctgtttgcccagcacagagcctgccgtgctttgacccagcaagtcccaccgcaccttccagaggcactgtacagcgtgcatctgttgtcagtacagttttatttgctgtggaatccatgagagccggaagcatcgttggggccgtggctagcagagctcatggtgaccagtcctgggcctgaccaatgggtgattacatttaaaaaccaaaacaaaacaaaacaaaataccaagaacagatcacttgccatggacatcagtaatctattggtaatggtggaaatttcatgaaaatttcccctaaaccataacaaaaactgtcctccttaccccaaaagtgctggaggaaagatggttgcatgacttgacctctctttgaacttgaaatgctaccttcctacccggaaatgcgacacactatacttaaaaggccagatggctgcaggctgtttgcacccctggctctgcccagggacacccctctcctggttctaatgctcagacccaggaggcagagtccgcagcccgagggagcttcaaggccgaggggtaggacctgcagggcccacaccacccttctgatggagagctttgcacatgcattcacacacacatgcctggcgggatcgcagaggatgggtctcgtggcaggagtgggcagaatggggtgcattttacagaagagtcacagagaggctcgccctcggcggaggacacacagctgggtgggcgtgtgggagtgcaggtgtgctgactccgaaccaagggagagctctccgtcctgagctcgctgcccctcacgatgcacacggctgatggctgaggtcagcggtctcttccctgagtggcaggtgtggtccctgggacttcataaaccatcctcatgacagttttacacttagagtccccaatgcactcccaggaggtggcctgggcaggcaggcatcattattctcatgttacaggtgaggaaactgaggctgaaggaggcagaaggccacatacccggggagaatcgcaggcagcaggggccaggccccttccacagcactgcctctcacccttctcccgaccaacccccaagggcatgcctctggcttcatgaaccttcgggggaaattagctttctagtttgggggcggttccctctgactggagacaggacagaatgctttcacacccaggaacggccgtgcagcctggcttagaaacaagggacgaagtggatcctgaggctcattccctggggactccaagaatggggcaggcccagctgcgcagccagtcctggctccactgacttaggctgcacccctgcacatatgtgtgtgtgtgtgtgcatgcgtgcgtgtgtgcatgtgcgtgtgtgtgtgtgtgtgtgtgtgtgtgtgtgcgcattttcccaggggacctctcctccttcctctgaggcaaagtggcctgcaggggcccctgcagagcatacagggaggtgcttccttccctctgcccagcgagcaaagggtggagccttggcacccccagcaaccccctccaagggtggagccttggcacccccagcccccaccccgcaagggaaaggggaagctgcacgaggagcaagatttcattccccagagggcacagcttgggcagattcccatcatctaggggctgtgccccacatctatttctgccaaacaagaagcagacgagggggctcaggggggcgggcctcacaggaacggaagcaccaccccacctctattccctgtggcctccaaaagagctgggcaacctctgccagccactaccccttagcccaaggggagtcctcattccagagccagcatcttcatcttgtcctgatgccctgcccacccccgccgagcttcacactgggctgctatggaaaactgaaaggtcagagggtggaggtcctctccctcctggacatggaaacctccccctgcctggcacttcggctggtcaggaacagtggctgctcatggagctgccctcccaccttcagaccctcctcctcccccgcaggggtgggctggggccctccctccctctgtacttgatccatgacttgtgagttctgagtcctcagggccgagacttgagtcagaaccttctggagcagtacgcatttcccctctgcacctggtgaggacaccaggctcctcgcttcctccccagatctctgagtgctcacccgaccccccaaccctggcgggaccttccagggctggcaagcatcgagcctgaccacgttgcctcttgggtgccagcacgcccacatcaaaggtgtcccctcttcccagaggccctgagcaacatcgggcgacgctgtcagcagacattagcagcagagctgcaccacgcatcaacttttaagtatgcgcacacacgtacgccagccaataacattaagtgtcattttaaaaaatgggttaaataagcagcattgctgaggatggccgtgcagggctgattatcccctatttgcacgttctggcggtgggaaggctagaagtctaatgactgaattatcgccctaatgcctctcgctggctgggaataatcccggggcaacagctgccgcggggtttttggctggtttcctctaattgcatccagattaagggagttgtggaggggcggggcttctccatcccccgcggagcagcgtctcctccgccaagccctgaacacccagctcatggcttccgaggtcctggctggtccgagaggtgcagacctcactggggtccgggccagcccatggggagcgtgaggtgcgagcagtgcacggtgggggtggcacttggtgcagagatgcagctgattggtccgggtcaggtcttggggagcagcaggggtgagaagctgtagggccaggagactcagaaggaatgccttctactaggaccttcccaagtgaggggagccctggacctgtctatcctcttcctccctcccaaacacagcggttcaaaggcacgaggtatctagtgaaatgctaggaccagggacgctattcccctggagcaggcgggtggggaaggagtgctccaaagcaggcattattaggacacagactctccagagtcccagttgtttagccctccaaattctcagcctactgccacccgactgtgcagagcggacaataaagtggcaggcctgtcccccaccccttaatgctgagcccagccacgtgacttgctgtggccaaggggagagctgcaggtgtggtgtccaccaaggcttggaaaggcacttgctgtctctccctccgtgcctttggctgtgccatggctggcctgcaggagggatgcaagagaccacagagcagggccaggtccgacctctgcaccatgagcatcccctgggacttaacaacccactggccctaaacaaacaagcccagcctagaccagaagaatcaccctgcccagactgctgactcctgccctagatcagtgctgactgttgcaggccaccgagtgttggcggatttgttacacagtattgctgtggcaatggatataactggtttctagcggagggtcagggcagaagctccagccacctccctagcccagaaaggcaaccctctcttcccagaagcaacatggatgagaagcccaccccattcccaccacaggatcccccactgctagacagcaatggtcggtaccccaggatctgggcactgatggggctccaggacggtctcctcaaaaggctcttaggcagacagacctgggaacttggaagtacctgctggacgacctgggttcatggagaaaagagaagccgagaaggtggaggaggccggtaagtggtgacctccgctttcctgctgaggaacactgctttgaagtggcatggcccagcagtgcccaccctccagggagaaaagctttgagtgggaagaagccttctatcctggtccccatgatggttctcagcacatcaagggtttttctccccagaaggacgcgatggaggatttcaggagggatttggtctcctcgctcaaggagtggctttctgtgcaaatggctcgacacttctaagctggctgggagttctcacagcatagatcgcacacccttttctgtccatctctaaatcccagaaggagcaactgatacacaatcttttggaagagggagagtctgttgggaagacctcattcccacatagaaggcagagagccctgagtgctggctccttcactgtggtcgctctcacgtccgaccacctgagaagctgacttacatatctgagttcacaggtcctgaagggaagtggaagagtctaactatttccaggtgtccttgtcttggttggtcagctaatacactaccacgtccctgggacaaagcagatcattgtcagaggatcttgcaaacacaaacacgcacgcacgtgtgcatgcatgcatgcacgcagggacacacgcacacatcgacccattcaagccccagctggttgctgtatttggtggagttgaccttaaacaacgccaaggaacctcacgtagaagacccccagcaaagaaaaaggcatcagatgcttctccaacagcctgaggctcaggctcctgggcagacagttcccttcgtgtaccaggaggacgaaatgtttaaacggataaacattacaagcgccagctcctcaagcctgactgctcttccgcctctctatccccacatcggttgggctttttatcttttgcttttcttttatggcagatgcctttccatcggcatcccagctgtggctggggacgttttgggaagtgtgtttggctcactccgagagaacgaggtctcaagaggaagtgtgtctggcttgcaaagatgtccctgggcctggacaggaccccgctgtgttctgcagccctcgacgcagtgggtgagtgaggccttcctctcctgtctctgctttcctcattgcctggcgacgctgtctggctgccctcgagggtggagcaaatcctgggacatgttgaaatcctccagggcagccagcaggagagcccagccagcctgcgtctcaggtgcggtggctgcgcgttccactgcagcgtttcaggagctgactttcctctgggtggctgtagatctgacttctgtcacttccagactctaattttgtcattaatatgaaaaggttcctctcatgttgcccaaaagcattttccttaggtttctaccgtcccctgtccccttcacgcccagccccaccccctcccgtgcccagggcctctgaggaggtcccctcaacccctgtccggtgtcgggggcccgacctatctgcggaagccgaagccgtcctgcggcgtctttgggcccttcttgccttccctcagggacttgggggaaggcatctccaccgtgcccccgtagggacagctctccgagccgggatggtggccggtgcactccaccgcgggcatggagccgctgtcccacatgcctgacccgcacagcttacacagatcgtgcaggctgcaggggatccggggcaggaggcggaactggtacagcaaactcctcgcctgcagacagaggacggggggtgaggaggggccgggggacagcctggcagcctagggtccccatgggagtggccaaagacagcaacagcagcaacaacggcctgcacctcgggggctcaccgagtcctggactgagggctctgcctgcatctcccaccatcaccggcaccacggggccctgggtcttaggtggctgcagtgatgggacccacaaggcactcgggctgtgctcacaggtggctcgaggtgaacaaggcccttgaatgggcttcattcaggagggtgaacaggaccaacaccagcacagggccgggtggcgtccagccaagcccacctgtccctttggcagcacccctctcttcttcccccgcaccttgctccaccccccacccccagcagcctctcagctcctgcaggatctgtgtcctgtgccagaggacaccaccgacctcgggacccccgctcagtgccctgaggaccaccagagagctaacgggcagcatctccaggaggcgtctgggaagtgggggagggggccaaagcccaaggtccccagtattctggccaccctgtccccaggtccagcctccttctcagtgttcccagttctgggttgtaagcgaggtaccccagggtagggaacctgtcctgtccgtcagccccggtgaattcgttccctcctcagccagcgagggaggctcctgtgtcagggctggcaccccaggaaagtgaggtgacacagccaggccgagacaggtgctgaccacgaggccttagtggggagcccccagtgctatgggtgggggagggcacgtgctggggggccatggtggggatggggctctgggggcggggcccacatctggggcagcctcacctttctgagaacgagctggtggggtggggctttgggggcggggcggggtggggcccacatctggggcagcctcaccttccggagaacgagctccccgttcatgtgcatggccaggtttccgaagtgcaggagcatctggtccgtggccagctgctgctcgatgacgtcatccccgtagatggccacgatggccacgcagatgaaaaggtggaagtagtccgtctgtggaggcgggtagagttcagacacgggctctgaccgagccccaggccctgcactcagggggaaactgagtgccagggtgcgagtgagggctccagggcgaggggtctgggctcacagcccagctcgggggccgtgtggccctgggcaagctgcaccgcctcttcggccctaagtttccccacctgcacatggggtctgtcccagtacccgcatgcccaggctgctgtgacatccagaggggacgatgctgagctcagcccccacgggctgctgctgctctcctgggtggtgatgtgggtggtctccatgacagggtgggggtgggggggtacaaagagcacccttcctcagaaggcctggcctgtgctcatggggaggactcatttgtaatggtcctgagcaacggtgtgtgcggaagtctgggtcagaactcactccagcgggtcatggaatgcgcctctggcagccacccacgggtcagcctgtcctcctggctccaggccacaccccccaatcatgccccagagatgactctagggtttgtggctagaaaagtgggaagatcctaacagagcgggcacagcagctcacccacagggtggctgaaatgatcgccctgtccttgagcctcttttcgggcatactttgaggactccgcagccctccctttaaagaccgcctcacggggcctgccagcaacgcgctgtgtgcagcaggaagcccacgccaggtcctgacggctgcatcctgtgtgctctccggcctggccgcctcaagacacgccacctttgatgcacacgcgcttccggaggcacaggaaggacgggggcactgggaagtccatgtttagtctcctgacgtcgaccacacaaaccagacggaacggtgtccccggcccaggctgagcggagcacaccatgagggcagaggctacaggtgactcccacgccccagcctgctcctggagagaccatgcaccaggctgcccggctgcttcctctgaactaatctgggacggtcttgttttggctctgacggatccttttgcagtgatttgaactgtggctggtgcgagacacagcggaggggttgcaggaaggtggacgcccagcttctctgggagaggaatgtggggagggagagggagggcacgatctccacagcctgcacagcataggcagatttcagttcccaggacaggcagggcgtagggccgtccagccccaccacatgctgacagcggacggatagcatcaaaagcctttctcgctcaggggtcactgaacagttaaaggcctcacctggcagcaaccttcccattccacagagctcactctcagctcatcagcagcccacccccacccccaccccgtaatactaccaaattgatcgagggatgggaccgaccgtggctaaatcaagcccacagtctgaaaacaacagaaacttgctttgtggacttccaacacaatggcagccaacagagatcccacgtcacgtgggcctcccgctggaattctgactagatctcattacacttgggacacagtaggtgtccatgggaaagggacccatctgccgggccacgcgctgagttcacgggtaacatcagcctgaacgtaaaggaatgagggcggcaaatctgccactgggaaaacgtgcaatgaggcacgattttttttaattcgggagtggtgggaatgaagcctctcagaccgtccatgccgtgcttcccttcgttaatgcagatcgtccaccctgcacgtccacgtccagcaggctgagccaggagggaaacctagacccgggccaggggcgagccgatgaccgcatgcaaaggcggcgtgtggtaccggcactcggtggcttcagactcgctttcatcagacatcagccccctgcggtgtgagtgaggacaggagacgctgacgcaaatgtcttccagcagatgggtgtttgcctccatcttcagggttctctgacggaggctgctggagctgccgtggtggatagagccagctcctgcaaaagggtccagccctcctggatgcgtcgatgtgagttttttttttaaaaggctgatggactcaaagagacttgcttatcttttgacatctccagcttgtccctagtttgggcgttaaggccatgtgacagagccagtgctgtgctccaaggggaatttgctgagaagatgctggtgacggtggacggagagtggaagtcggtatcactgattggggccctctggaggggccgacagggaagtgggatctcaggccctttctctgcacagcagggtaacgggtgagtcggccctcgtggcagggcggtcccgagggggtggagcggtgctggctcacgctcgtgggcaccagcgtcctgggctgctgtggcctagtgtaggccccccacagtgtcactcacactgattggttgtgacaggagggagctcagccccagaaagtggtaatgagtgcagtcagcgggcaatttgcatcgatttcagtgactggggaggcgagctgtaaggtctgaagccagccacgtgggacgggaaggcagtcgccgtatggggggctaatgtgtggctgtgggtggggggcggcgaggcggacaggggcagcaggcagggtggccacggtggttcaggggccatggtcccaacctccccagccctggcccctgccctggtcacctggtagtgggcccagcaggcctcccagatccgcagcgcttcggcctcggggaactcccgcttgaagcacagaaggagccagcggtggcagaagagcatctgcaggccgtcctcgcccagcgagaccaggtgctggtagaagcgcacgtgcgtcagccgcagcagctcgcgcaggtacagctgggggtgaggccgtcacgcgttagttagctccggtcccatgcggcctgctgcccaggaagcccactcccactggggcccttccctgggccaccccagcctggaaaagcacacccaggggcctctacctgctgcatgtgcctgcccccccaacgctccattccgccgctggaatcggctcacacctgcctctgccagttcctcccagatctgactgttccggaggctgtggtgtggtccagggtgaggcagagtgttgtgcccgggcgtggcaggacgctggcagccgctccatggccaggaaggctccccaccctcagtgcacacttgggggctgtttcccacgtccactcctcctggtgaggtgagtggatcatccagggagcccccccacccctcttcggctacgctcacccagatctatcatcttccagagctgttttagggcaggaaggggacgtatctgagccccaggatgctcgattcctgccattaaggtcatctcccaatgatgtgggacaagatcggggctatttctggcagcactcgggcccaggccgctgacttcatcaatgccgctggaaaatcaatctccagcattcagtgagtcacccagccatgcgctgccatgagccgtcagaggcgaatggcgttggacactgtaactgcctccccaagcaatgtggacacccgacgtcacacacacccgttgatgcagagtgagcaggcttggctgggttcagccccccggcccaggtggagttagatcacagctggggggatcctggggcagagctcggggccacatgcccccttcccacacaggtggcccattgttcccacgggagactgcgctgaagctgtgcggccagccctccgccctgtggcctacggccaggtcaagcccactcgtgtggctgacccccttgcagatgctccactcccgccccctgtgcaggtgcctgcacctccctgcttgggctcctttgccttcaaatcctctctgttggcatcagctctcccagcctgtcatcagcgacccactaacagtcagtctatagcagcggtccccaacctttttggcactagggacccgtttcctggaagacaatttttccacggacaaggtagtgcgaatggtttcaggttgaaactgttccccctcacatcatcaggcattagattctcataagcagtacacaacctagacccctcacatgctcagttcacagtagggttctcgcgttcgagcttctgtgagaatctaatgcagccgctgatctgacggcaggtggagctcaggcgggaatgctcgctggcccgtccaccgctcacctcctgcggtgcggccagttcctaacaggccatggaccagtaccagtcctgggcctgggagtggggatcccattctatgagacacactccgtggcctggggctggggaaccccgttctacaagtcacactctgtgtcctggggtggggaccccattctacaagtcacactctgtgtcctggggtggggaccccattctgagacacgctctgtgtcctgggggtggggacccccgttctatgagacacactctgtggccctggccttcaaggccctccatcagctccaccctcactacttgtgacgggtctggtccaggaagaccaggtcactcagtcccaccactgggactgctctgctcagcccagccttagcgacactcagggccagaccccacacaccctggagctgtccccggtgcaggagccctcttgtccttatcacgggcacctcccacagtgctccccgacacccagcgtcctctgctcacaatgccagcttcctggcccagccaggagggtgaatgtctggtgactgcacccggcaggcacttggttgacatgggtgatgtgtgctgagaacagtgagcaggtgccctggctcagccctggttcggtcccacacgctggccctccggcgctgccttacccagctgggctcagccccaccaccgacattcagtgcttcctggtctacatagggctggtccttttgaggaggccttgacgggagaggtgtcagcagggcaccccaggggaggggtggggtgtgaggactgccccagagacctcagggggtttcaggagcccctcctcttcctgtctgcactcagaagccctggctgtgttgactcctgcagggagcagcttagacacacctgaggacccattttctaaggctcagagggggctgggtgtgatggtgccacgtcttccttgccagccagggagcttgggccaggttgtcacgtgcaggggtggaaggccaccagagcggcccacacaacgcggcctctggacctgcagggagtcagagggccatccccggaggccgagataggctaagccgcccatatcccacgggcaagtcctatcctggcgttcccactgcccactgacctacagcagccaagccacgcatcaccacggcaaccccggctacaacgggagaggcaacacgggccctcacatgcccttggacgcacccatccccctgagcctcaccagttgtttctccatgtcctcgtcccggggtgagctgacgaagatcgtgttctgcatcaaacccacaaagcaccagaaggtgtctgactcatccaggacctcggccaagatgggcgccaccaggtccgacatcccttgggaatagccgacggcagggttgtacacggcgtagttcagcaggatcctcctgggaggcggtggagacagcagtgggtggggatgaccctcaccgcggcacactgcccagcctgcagaaccctgggccgtggaccctgccttccctcgcttgccttcacctcagtggaaggcagctgtgccaccatctcagagcccaagcttagcttccagacacacagacccttgctttgcaaaaggtaatggcctggccgggcgcggtggcccacgcctacaatcccagcactttgggaggctgaggtgggcagatcacctgaggtcaggagttcgacactagcctggccaacatggtgaaaccctgtctctactaaaaatacaaaacttagccgggcatggtggggtgcacgcctgtaatctcagctacttgggaggctgagactggagaatcgcttgaacccggaaagcggaagttgcagtgagccgagatcacaccactgcactccagtctggatgacagagcgagactccgtctcaaaaaaaaaaaaaaaagtaatggcctgctattagctgctgtctaggcccagaatcttgagagcaggggttaagggggaacatggctctgattttctgaagggtggactgcctgtgacaaggggtgggctggcagggacatttctgtgggctgctaattttgtgcaattatttgctaggctgtagcagaatgtcacagatgccagcctctggctctgtgtggctgtatgactacgggaccacccacggggagatggagggggtgcatggggaagctggtccatggttagtgtgagccaagcaaggacaggcttggtggtgcccaggggatagaggggctctgtgggcagggacctgggtggcttccctgggatgccatggctctgagatgccaactgacgtagctcatgagtagcgtatccttcacttctggggctttgatgtatgaacctggaagagagcccctgcagaaactcgctgggggctcatccacttcccagagcggtcaggtgaggcttgcagacttgcagatgggaaaggagctggctggggagggagtacctcatgctctccacattgggattgtcttccccccggaagaactggttgttccgatctgtccggaccacgtctttgtccacagtgaactgcacattacgccagaacgctctgtgctcctcgggagtcatggagagcctgtgtggagccgagcacccagccggggtcagcgggtggcacccagaggcatcgtgtggcgcacacactgcaggaagccacccttcctcccaacccccgttccctggacgggagctgggcggctgctgccggctgcagaccctccccggatgcggcggatgggtggcgtgtatccaaggctctccttgatattaactcagcctcacagtctccagcgtcccaggaaggagagcaagttgcagcccagtgggtaatgaggccttggccctggcccagcgttctggaggggagctgagcacagcccaggggcttcacccagtcccagcctcctggagagagagctgagcccagtcccgggttagcagatcccaagtgggacacagtctccggatgccttcacccctccaggccctgctcccagccccagccttcagctgtgggacgtcagcgcctagttaagtctgttgaacgagaattctaaaaccttgacatgtgagctaacgagccccgcagctccgaggcccgagtgcttggtttaatgactgcacttatcccaccctatcactcacgttcctgggagacccatttttgaaagaaactatgggtcacgaaacatattatcaatgctgaattgcacctcaaattgccttttcaaatgacattttcctccgcggctcggcggggtgggccgggctggccccggcggttaccttttctgctggatctcagagtactcctttcgcttctgcagccgcagcgcctcccgctcctccgacgtggactcgtggctgtaatagcgcagcaggaagggccagacctccccgcggattgacacatcaataccgccaaagaaaatggcctggaggaagcggcaaaagttggggaggggataaaatggggcagctcaaagaacccccaaatccccagagatgtgtgttttggtggtttttggtgcgccttgattcagatctctgcaatttgcacatatttacaaggggaaagcagtggccttcaattcccatacaggacacaaacccggctcatttcaatgtcaatgccccccctggggtggcgctcagattaacgtgtcgttctcacgtcatggcctaatccctggttttggaaatgctgcatttcactgcaaacccttctatgcaggctgacacggtatccccccaaaccctcgagggaggtgttgtgttttgtttttttttttcaacgcagcagctttgattgctttatcggtgtgttcacagagagcctcacacaagaaaacggggccctcacgaggaggtggcccgtgggtgcgggcgggcggccaggccccggccctccttccctctcgctcgttcccggttcccggccggctctccgcggggccagctgggcggacccggacctcaccttccgcagcttgtactcctcctccacctggcccagctcattcaggtggttgagccaggcggagacgccgagcctcttgtacatgctctcctcggggtgcgtctcggaggacggcagcttggggcggcggatggagaactgcatgcatgtcttatcgggggcgacctgctggacgggaggaaaactgggcaaaggtcaggatctcagccgcgcggcttcagaggccagcagtgcttttcccaggaataaaagcctctctctcttctgaaaggagggcaagggccgtcccctgcatacaaacccctaaatggcgagtgtaattaggcgcaattaaaatgaaaataccttcatcttaaaatcggtttccctctgcggctctctcctccccggcccactgtgccgccgccccccactctctccaaccccagccgcaaaaacggaatgaat

SEQ ID NO: 383 - DNA, 18515 bp, Homo sapiens; identical to SEQ ID NO: 382
  source 1..18515: mol_type = genomic DNA

SEQ ID NO: 384 - DNA, 7005 bp, Homo sapiens
  source 1..7005: mol_type = genomic DNA
tgccactgggaaaacgtgcaatgaggcacgattttttttaattcgggagtggtgggaatgaagcctctcagaccgtccatgccgtgcttcccttcgttaatgcagatcgtccaccctgcacgtccacgtccagcaggctgagccaggagggaaacctagacccgggccaggggcgagccgatgaccgcatgcaaaggcggcgtgtggtaccggcactcggtggcttcagactcgctttcatcagacatcagccccctgcggtgtgagtgaggacaggagacgctgacgcaaatgtcttccagcagatgggtgtttgcctccatcttcagggttctctgacggaggctgctggagctgccgtggtggatagagccagctcctgcaaaagggtccagccctcctggatgcgtcgatgtgagttttttttttaaaaggctgatggactcaaagagacttgcttatcttttgacatctccagcttgtccctagtttgggcgttaaggccatgtgacagagccagtgctgtgctccaaggggaatttgctgagaagatgctggtgacggtggacggagagtggaagtcggtatcactgattggggccctctggaggggccgacagggaagtgggatctcaggccctttctctgcacagcagggtaacgggtgagtcggccctcgtggcagggcggtcccgagggggtggagcggtgctggctcacgctcgtgggcaccagcgtcctgggctgctgtggcctagtgtaggccccccacagtgtcactcacactgattggttgtgacaggagggagctcagccccagaaagtggtaatgagtgcagtcagcgggcaatttgcatcgatttcagtgactggggaggcgagctgtaaggtctgaagccagccacgtgggacgggaaggcagtcgccgtatggggggctaatgtgtggctgtgggtggggggcggcgaggcggacaggggcagcaggcagggtggccacggtggttcaggggccatggtcccaacctccccagccctggcccctgccctggtcacctggtagtgggcccagcaggcctcccagatccgcagcgcttcggcctcggggaactcccgcttgaagcacagaaggagccagcggtggcagaagagcatctgcaggccgtcctcgcccagcgagaccaggtgctggtagaagcgcacgtgcgtcagccgcagcagctcgcgcaggtacagctgggggtgaggccgtcacgcgttagttagctccggtcccatgcggcctgctgcccaggaagcccactcccactggggcccttccctgggccaccccagcctggaaaagcacacccaggggcctctacctgctgcatgtgcctgcccccccaacgctccattccgccgctggaatcggctcacacctgcctctgccagttcctcccagatctgactgttccggaggctgtggtgtggtccagggtgaggcagagtgttgtgcccgggcgtggcaggacgctggcagccgctccatggccaggaaggctccccaccctcagtgcacacttgggggctgtttcccacgtccactcctcctggtgaggtgagtggatcatccagggagcccccccacccctcttcggctacgctcacccagatctatcatcttccagagctgttttagggcaggaaggggacgtatctgagccccaggatgctcgattcctgccattaaggtcatctcccaatgatgtgggacaagatcggggctatttctggcagcactcgggcccaggccgctgacttcatcaatgccgctggaaaatcaatctccagcattcagtgagtcacccagccatgcgctgccatgagccgtcagaggcgaatggcgttggacactgtaactgcctccccaagcaatgtggacacccgacgtcacacacacccgttgatgcagagtgagcaggcttggctgggttcagccccccggcccaggtggagttagatcacagctggggggatcctggggcagagctcggggccacatgcccccttcccacacaggtggcccattgttcccacgggagactgcgctgaagctgtgcggccagccctccgccctgtggcctacggccaggtcaagcccactcgtgtggctgacccccttgcagatgctccactcccgccccctgtgcaggtgcctgcacctccctgcttgggctcctttgccttcaaatcctctctgttggcatcagctctcccagcctgtcatcagcgacccactaacagtcagtctatagcagcggtccccaacctttttggcactagggacccgtttcctggaagacaatttttccacggacaaggtagtgcgaatggtttcaggttgaaactgttccccctcacatcatcaggcattagattctcataagcagtacacaacctagacccctcacatgctcagttcacagtagggttctcgcgttcgagcttctgtgagaatctaatgcagccgctgatctgacggcaggtggagctcaggcgggaatgctcgctggcccgtccaccgctcacctcctgcggtgcggccagttcctaacaggccatggaccagtaccagtcctgggcctgggagtggggatcccattctatgagacacactccgtggcctggggctggggaaccccgttctacaagtcacactctgtgtcctggggtggggaccccattctacaagtcacactctgtgtcctggggtggggaccccattctgagacacgctctgtgtcctgggggtggggacccccgttctatgagacacactctgtggccctggccttcaaggccctccatcagctccaccctcactacttgtgacgggtctggtccaggaagaccaggtcactcagtcccaccactgggactgctctgctcagcccagccttagcgacactcagggccagaccccacacaccctggagctgtccccggtgcaggagccctcttgtccttatcacgggcacctcccacagtgctccccgacacccagcgtcctctgctcacaatgccagcttcctggcccagccaggagggtgaatgtctggtgactgcacccggcaggcacttggttgacatgggtgatgtgtgctgagaacagtgagcaggtgccctggctcagccctggttcggtcccacacgctggccctccggcgctgccttacccagctgggctcagccccaccaccgacattcagtgcttcctggtctacatagggctggtccttttgaggaggccttgacgggagaggtgtcagcagggcaccccaggggaggggtggggtgtgaggactgccccagagacctcagggggtttcaggagcccctcctcttcctgtctgcactcagaagccctggctgtgttgactcctgcagggagcagcttagacacacctgaggacccattttctaaggctcagagggggctgggtgtgatggtgccacgtcttccttgccagccagggagcttgggccaggttgtcacgtgcaggggtggaaggccaccagagcggcccacacaacgcggcctctggacctgcagggagtcagagggccatccccggaggccgagataggctaagccgcccatatcccacgggcaagtcctatcctggcgttcccactgcccactgacctacagcagccaagccacgcatcaccacggcaaccccggctacaacgggagaggcaacacgggccctcacatgcccttggacgcacccatccccctgagcctcaccagttgtttctccatgtcctcgtcccggggtgagctgacgaagatcgtgttctgcatcaaacccacaaagcaccagaaggtgtctgactcatccaggacctcggccaagatgggcgccaccaggtccgacatcccttgggaatagccgacggcagggttgtacacggcgtagttcagcaggatcctcctgggaggcggtggagacagcagtgggtggggatgaccctcaccgcggcacactgcccagcctgcagaaccctgggccgtggaccctgccttccctcgcttgccttcacctcagtggaaggcagctgtgccaccatctcagagcccaagcttagcttccagacacacagacccttgctttgcaaaaggtaatggcctggccgggcgcggtggcccacgcctacaatcccagcactttgggaggctgaggtgggcagatcacctgaggtcaggagttcgacactagcctggccaacatggtgaaaccctgtctctactaaaaatacaaaacttagccgggcatggtggggtgcacgcctgtaatctcagctacttgggaggctgagactggagaatcgcttgaacccggaaagcggaagttgcagtgagccgagatcacaccactgcactccagtctggatgacagagcgagactccgtctcaaaaaaaaaaaaaaaagtaatggcctgctattagctgctgtctaggcccagaatcttgagagcaggggttaagggggaacatggctctgattttctgaagggtggactgcctgtgacaaggggtgggctggcagggacatttctgtgggctgctaattttgtgcaattatttgctaggctgtagcagaatgtcacagatgccagcctctggctctgtgtggctgtatgactacgggaccacccacggggagatggagggggtgcatggggaagctggtccatggttagtgtgagccaagcaaggacaggcttggtggtgcccaggggatagaggggctctgtgggcagggacctgggtggcttccctgggatgccatggctctgagatgccaactgacgtagctcatgagtagcgtatccttcacttctggggctttgatgtatgaacctggaagagagcccctgcagaaactcgctgggggctcatccacttcccagagcggtcaggtgaggcttgcagacttgcagatgggaaaggagctggctggggagggagtacctcatgctctccacattgggattgtcttccccccggaagaactggttgttccgatctgtccggaccacgtctttgtccacagtgaactgcacattacgccagaacgctctgtgctcctcgggagtcatggagagcctgtgtggagccgagcacccagccggggtcagcgggtggcacccagaggcatcgtgtggcgcacacactgcaggaagccacccttcctcccaacccccgttccctggacgggagctgggcggctgctgccggctgcagaccctccccggatgcggcggatgggtggcgtgtatccaaggctctccttgatattaactcagcctcacagtctccagcgtcccaggaaggagagcaagttgcagcccagtgggtaatgaggccttggccctggcccagcgttctggaggggagctgagcacagcccaggggcttcacccagtcccagcctcctggagagagagctgagcccagtcccgggttagcagatcccaagtgggacacagtctccggatgccttcacccctccaggccctgctcccagccccagccttcagctgtgggacgtcagcgcctagttaagtctgttgaacgagaattctaaaaccttgacatgtgagctaacgagccccgcagctccgaggcccgagtgcttggtttaatgactgcacttatcccaccctatcactcacgttcctgggagacccatttttgaaagaaactatgggtcacgaaacatattatcaatgctgaattgcacctcaaattgccttttcaaatgacattttcctccgcggctcggcggggtgggccgggctggccccggcggttaccttttctgctggatctcagagtactcctttcgcttctgcagccgcagcgcctcccgctcctccgacgtggactcgtggctgtaatagcgcagcaggaagggccagacctccccgcggattgacacatcaataccgccaaagaaaatggcctggaggaagcggcaaaagttggggaggggataaaatggggcagctcaaagaacccccaaatccccagagatgtgtgttttggtggtttttggtgcgccttgattcagatctctgcaatttgcacatatttacaaggggaaagcagtggccttcaattcccatacaggacacaaacccggctcatttcaatgtcaatgccccccctggggtggcgctcagattaacgtgtcgttctcacgtcatggcctaatccctggttttggaaatgctgcatttcactgcaaacccttctatgcaggctgacacggtatccccccaaaccctcgagggaggtgttgtgttttgtttttttttttcaacgcagcagctttgattgctttatcggtgtgttcacagagagcctcacacaagaaaacggggccctcacgaggaggtggcccgtgggtgcgggcgggcggccaggccccggccctccttccctctcgctcgttcccggttcccggccggctctccgcggggccagctgggcggacccggacctcaccttccgcagcttgtactcctcctccacctggcccagctcattcaggtggttgagccaggcggagacgccgagcctcttgtacatgctctcctcggggtgcgtctcggaggacggcagcttggggcggcggatggagaactgcatgcatgtcttatcgggggcgacctgctggacgggaggaaaactgggcaaaggtcaggatctcagccgcgcggcttcagaggccagcagtgcttttcccaggaataaaagcctctctctcttctgaaaggagggcaagggccgtcccctgcatacaaacccctaaatggcgagtgtaattaggcgcaattaaaatgaaaataccttcatcttaaaatcggtttccctctgcggctctctcctccccggcccactgtgccgccgccccccactctctccaaccccagccgcaaaaacggaatgaat

SEQ ID NO: 385 - DNA, 421549 bp, Homo sapiens
  source 1..421549: mol_type = genomic DNA
cggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcgggtaagtggattctgaaggcaccccttgaacttggtagtttccccaacaaagaaagtttacagcccgaaaagtgtccttgggaaagcgccgacatttccccctagccacacgttgtaagtcaactagaaagcaaaagccatttcagactgcagtttttggttgaaaatggaaaatgctgttttggttagtcattattcactgggtagtgttaattcaattccaactaagttctaattcagataataaaagttaagcaaatttgaaaatagagcattgcgagtatttacatgctctttggcatactacttagttctgtaaacacttagaggaaggacaacgtgcgatataatctttatacccacatgattagtctactttttaaaatatccaagctgggtgaagtgcagaagtctgatatactatgctaggaaatgagattactggaaaatgttcaactagtaacaaattagtgcaaagttattataaagttacactgaacttcattctagtcttctaaacaatttctcttgaagctagattttcctccttttatgtagtgtcctgttgctgtaacttggaaacaggatttctttaatcgtgagttagggtatgaggcgtcgagacttgggtgcaggttttagggtgtccgcatggtgtttggagtgtggagagtgactcacaagcagctggtaggaaagaaaacagccgaattttgttggatttgtccttcataaaacacccatctatttcctggcctcaaaagcaaaagggtagtactgcttctcctctatgcacacttataatttgtctttttgtaagttattttctccctccaggctgcttttatttgcacatttcagtggtataaaagaggaagttggtgttacaatgtttgattttctctaggcttatgtatatgtttatggaatattattgttttttagtatatgatgttgaacatatataagattacacttctgggctgggcgcggtggctcacgcctgtaatctcagcactttgggaggccaaggcaggcctcccaaaggcaggcggatcacctgaggtcaggagtttgagaccagcccggccaacatggtgaaaccctgtctgtactaaaaatacaaaaattagctgggcttggtggcaggtgcccgtaatcccagctactcgagaagctgaggctggagaatcgcttgaacctgggaggcagaggttgcagtgagccgaaatcgcaccattgcactccagcctaggggacagagtgagactgtgtctcaaaaataaataaataaataaaacttctggtaactctagtcagtcagtcagtagtaaccagttagctactgacttggcttacttctaaaaggttaggaaaatttgtttcatccaaaagcattttaaggagttaaataagttagtcattgggggaggttgtataaattctatcttatggacatctttagtagtaactatatagttaaaagcttttgtggttgctatacatatatgaaaagactttttaaaaaattctttgtggagggcagtttttttgttgttgttattttgaaatgtggttctctctgctgtcctaaacctatgttccaacagtttgaaactgattaatgggtatacgtttgaccttttaattaaaacattaatttgtgaatgatcaacattccctaataagcttttcacaggttgttaagagaaacaaaagttctgtgactcttagtgactactgagattgctgcttagaaaggagctggggagaaagtttgctgtatctgtttttcggtggagaaaatcagcagctaacatcttcagttgagtgtgtgggagtttggaatcttgtcatctcttccctcttccaaaggtcaggtcctttggaatcttgtcatctcttccctcaaggaccgtatcacacatgctataggacagaagttgcaaactcaaatgatattgagtggggatggtagcataagagaatgaaacaggccacatttaagaagaataatggcataggttcaaagataaagacaaatggcagctgacatttggcacagtgtgtgtgacagtttctggagggtgggaacaggggctccctgatgccataactgaaggggcaactgggctatggccaggcctctctctttgtctttgagaagtcagcaaactttttttttcttttattgtaaatattcatactaattcagatttattaccaaacacactgtagtccaacactgcaggctgaacaaccccatttgtggagtgtttttctgtttctttttttttttttttttttttgagacagggtcttgctctgtcatccaggctggagtacagtggtgagatcacacggctcactgcagcctcgacctcctgggcctgagtgatcctctcacctcagcctccccagtagctgagactataagtgtgcgccagtgtgtctggggttggggagtctcactgtgttgcccaggctggtcttgaactcctgggatcaagcaatcctcctgccttgtcctccaaaaatgctaggattacaggcatcagccaacacgctcagcctggggtggtttttttttttttttttttttttttttgagatggagtttcattcttgttgcccaggctggagtgcagtggtgtggtcttgactcactgcaacctccgcctcccaggatcaagctattctcctgcctcagcctcccaagtagctgggattacaggcgcctggctagttttttttgtatttttagtggagatggggtttcaccatgttggccaggctggtcctgaactcctgacctcgggtcgttcacctgcctcagcctcccaaagtgctgggattacaggtgtgagccacagcacctggccctggggtgttttttgaccagtgggttacctacgtaagaatctctgttacccaggcctccaggccacacagtcccactgtgctggacgtagcctccagtctggtggagcagcatgtttgtaaagtgaaatgtgtgggcgtggttgttctgtgctaggagctacatcaactacttcctggtggccactgactgtcctaaatgcaagctgagattttgcttcttcttgtggttaatgtgcaattccatacgcttttattttgtacatatattcattagttcttactggctcctatttagtagccttgctacagattcctcaaattgacatctttaccaaagttgactgactgatgactcccaagaagttttttttgccacccaacacttggcatccttccagagctacagcccttgcccgctctcagttgggattcctgccatctttgttttgaatcagtcttggttttcaaatgccacttttaccacattttaatttctaagttactgttactttaaaattattatcaagttagtttgttgtttggttaattctactatgtatagtgaatgaggcatatatgtatccatagtgtttttagcttgcaattttcaaataactagacatatatgaattgtagttcaaaatgaatcattcacagacctttggctaaaacagatacgtatatatctcccctatttgtgtttttggctcactgcaacctccgcctcttgggttcaagcgattctcctgccgcagcctcccgagtagctgggattacaggtgcccaccaccatgcctggccaatttttttcatatttttattagagacggggtttcactatgttggccaggctggtctcaaactcctgacctcaggtgatccacctgcctcggcctcccaaagtgctgggattacaggtgtgagccaccgtgcctggtctaactgtgatactttatagttatcacagagttcattttcctactggaaagtggacagtggggataactggtctcagatgactcttttgcctggaatatgtgggatggaatgacgggtgcttgagagctattgctctgaaagtgttgacagacatgctatgtctacacacatgtagactgacagacactctgtctacatgcatgtagcacccctggcagacacattctgtgtacacatgtgtggtgtcattgtcagacactatttccatgcatgtgtaggaccactgacaggcatcctatgtctacatgtgtaggggatgaaacggttagatgaagaaggctattttgtaaaccattctctagactcagttgcattgctctgtagccatactttgcccaggtcatggaggaagcagagtagatctgttcaactaatacatggactgccaaaggtttatgcggtcttttcagcaagggtaatagcaatccttcataatctacactaccccctctgctttcctcaccttgcgtcctctccacattccaactgtgccctgttccactcccctgagactggtctccatatggccccagtttgttgctaaatctaaagttctcttctctgtccttctctgttcttatttcacctctcagcagcattccacaatgtggaccatggcctcttcataaagctctttcctcacttgcttctgtgtctccacgaaactcggattttcctcttaggtcactagttgttccttctcagactcctttgctacctgacacctaaatgcaggggcaccccaggaattgatcttggaccccattctctgttctgggtgtgcccctccctagcagatctcatcggggcccatgattttaaatagtgtctacatgccagtgatgcttaaacccccaatctttagttctgatctggcctgaaatttctgtctcagatgcctactgcctgctttttcttagttttctccatcaccgcttgccacaaccaccatccactcagttgttcaagctgtaagtttagagtttatccttaattctttcctctccctctctttatcgccccatccaattcattagaacccatcagcgttacttccaaagcatgtcttacattggcctgcttcattttgtctccactgatgcagccccagtccaggcagccaccgtctcttgtctggacactgcatttgtgtcctgactggtctccctatgtccattcttgccctacaaccagtttttcacatagcagtcagagggatcttttatttattttgaaatggagtctctccttgtttctcaggctggagtgcaatggcgtgatctcggctcactgcaacctccacctcccgagttcaagagattctcgtgcctcagtctcccgagtagctgggactaccagtgcatgacaccatgcccggctgattttttgtatttttagtagagatgcggtttcaccatgttggccaggctggtcttgaactcctgagctcaagtgatcctcccacctcagcctcccagagtgctggattacaggcgtgagccatcacacctggccagagggattttttgaaagtgtgaaggggtgggttgcccctccacacctgtgggtgtttcttgttaggtgggacgagagacttggaaaagaaaaagaaacagagacaaagtatagagagagaaataaggggacccagggaaccagcgttcagcatatggaggatcccgccagcctcagagttcccttagtatttattgatcattcgtgggtgtttctccgagagggggatgtgtcagggtcacaagacaatagtggggagagggtcagcagacaaacacgtgaacaagggtctttgcatcatagacaaggtaaaggattaagtgctgtgcttttagatatgcatacacataaatatctcaatgctttacaaagcagtattgctgcccgcatgtcccacctccagccctaaggcagtttttccctatctcagtagatggaacgtacaatcgggttttataccgagacattccattgcccagggacgggcaggagacagatgccttcctcttgtctcaactgcaagaggcatgccttcctcttctactaatcctcctcagcacagaccctttacgggtgtcgggctgggggacggtcaggtctttcccttcccacgaggccatatttcagactatcacatggggagaaaccttggacaatacctggctttcctaggcagaggtccctgtggccttccgcagtgtttgtgtccctgggtacttgagattagggagtgatgatgactcttaaggagcatgctgccttcaagcatctgtttaacaaagcacatcttgcaccgcccttaatccatttaaccctgagtttgacacagcacatgtttcagagagcacggggttgggggtaaggtcatagattaacagaatctcaaggcagaagaatttgtcttagtacagaataaaatggagtctcctatgtctacttctttctatacagacacagtaacaatctgatctctcttgcttttccccacaaaagtgtgaatcagattctgttacttccttactggtggtctccattggcttcctctgtgcttaaagtagaactcagactcctcttgctggttcacaaagccttcatgatttggcctctgcctgccttttctgcttcttggatagaaactcctggaatgcttttctctctgatctttgcacacctggccccttctcgtcgttcatacttagcatctaggtcccttcctcagagaggcccaccatcaccccatctgaagcagccaccctgtcactcataaaccctcctgatggctatttatttctctgatatttttctccctacttcctcctggagatgtgagcttttcatcataaagcaaggacctagtctagtctatgctagtccatagggcagtgcttggcacatagtagggattcaacaaaactatactgatacaaaatggatagtttacaaaaggcttccacatacattatctttaaggctcaacagcaccataaattacctagggatcattctctccgtgttactgatgaggtaactgacgttttagttgaatggcttacctaaagttacataagtaacatggctagcagtgagaggaagtggaacctgtgcagagggagaaacaaagtttagttcaaaacaaaacaaaacaaaactgtatcataatgtctccactgaaacatttatgttaagaggtcagggggttgaaaatagcagaccagcagaccaacattcagcagacagagaaggatgctcagtctgctcacagcatgtgccctgtgcactggggcttctcctagacccttgcagggatccacaaggtcaaaactgttttcataataatggaacaccattggccttttccactctgttgatacctgcactgacagtgcaaaagtgatgaatcaagacagcggtgccaagctgtactactagttcctgatttctttgccatgcacatggagagaatgtccttgctaataaagcagtgaaaatgatgacttttactaaatcttgactgttaagcacacatctttttcagactgtgtgtgctgctccttctcctgcaggcaaagcccagtggctgcctggaggaggagcatctgctgccttcatggacgcagcacgtcccaaaggaatcaccgacaggccgcctctggatgttgaggcctgtgtccacggcagacgtgtttttgaaaatgaacttagtgagctgtcacttcaaggaatacagctgacagtatttgctgccagtcatgaaatttgaaccttcaagtgaaaattggttttggaaaacttgtatctgccgctgtgagcctggcagcttcccaagacttaaagatgtttctggtgagatccatagtgatattaatgaatggaattaatgttgtagaatgaaatgtgcccacatttggaacagctgcataattcagtgaacaaatatttccagatgaccaatccatgatattataaaatcatccataggtaaaagatccgttcaatgttagaccagtggattttaatgtaatagggtacaaaaagttcaccagaggataggtgtttttttttctttttttttaagacggaatcttgctctgttgcccaggttggagtgcagtggcgcgatctcggctcactgcaacctccgcctcccaggttcaagcaattctcctgcctcagcctcctgagtagttgggattacatgtgcctgctaccacgcctggctaattttcatatttttagtagagatggggttttgccatattggccaggctggtctcgaactcctgacttcaggtgatccacctgccttggcctcctaaagtgctgggattacaggggtcagccaccacaccccgcttgatgttctgttgtgtgcgtgtgtgtatattttttgttgttatttgtttgtttcacagttcactgcatccttgacctgggctcaagtgatcctcctgcctcagcctcctgagtcgctgggactacaggtgtgagtcaccatgcctagattttttttttggattttttgtagggatggggtctcactatgttgcctatagtgagagtttaaatattttattcaaatagattgcaacagatctttaagaaactaccacttactcaattttgttgtaatatcaaataataatattctcaattatttggatattctgatactcctgccattatgtatctttgtgaggccagatttttctcacatacttcaaccaaaacagtgtatttcaacccattgaatgtggcaccaaaaatgagaatccaaggtggggtgcggtggctcacacctgtaatcccagcactttgggagactgaggcgggcagatcatgaggtcaggagatcaagaccatcctggctaacacgatgaaaccccatctctactaaaaaataccaaaaattagccgggcgaggtgacgggcgcctgtagtcccagctacttgggaggctgaggcaggagaatggcgtgaacccgggaggcagagcttgcagtgagctgagattgcgccactgcactccagcctgggtgacagagtgagactctgtctcaaaacaaaacaaaacaaaacaaaacaaacaacaacaacaacaaaaaaaatgagaatccagttgtcttctatgaagctggatattaaagagatttgcaaaaatctaaaaaaagccacctgagacaagtgacaagataactgacaatttttgaaaatatagttatttgtagaaatgttatttatttgaatatataataagtttgatttttaagtgaattcataaatatatcaattatgtttttctgttttaaccttcaatacggaaaatgttgataaatgaaactcataaaaaagctctttgagggtcttcaggaacctttaagaccgtaaaggggccctgctgccagatgtttgagagttattagtgtagttagaagaaagtgggcctcatccttaggaagaagggcttgaggatatcaggtggctggtcagaaatgtcaggcagggccttgaagtgacattagataagaaacataaaggccctaatctgttgccctctttccattcgctctgcctaaagaactgttgaggtctctggacttggagctgggaggatgtttgtgaagagcctgtgtgattgtgagggcagtggccttacatgtggccacctagccctccatcaggtccttctattgctccagatttctagtgtgtgtccggagggagatgcaccaccgcccacccagtagctcttgtgctgggagtggaggaacacccagtctgtctggaggaatgtccactctgtctggcaaggaggaggtggccagaggttcagccaaggtggacagctcacgggaagtgtcctgtctctccagggcgctgctgcctagacagactgacagacacggtagcaccaaattacaatacgcaagtataggtatcaatcatagtaattacaggtgagaatgacattattacggggagcatcttgatttaatattaaataagtaaatcatttgcattgaactgcatttatgaaagaaatcatccacattgaccagcattaaactcccagcagccagtgacttcatgtagttggtgatggggagctgtcccaggattccagctggggagttgttgtgcataaatttgtgttttgaaataccttattggctatggatggagtggggtgattggagaggggcgagactggaggtgggggcaccaagtggagaggagttgtgctaatccaggtgagaagccctgggggctgggcgtggtggctcacatttgtaattccagcacttcgggaggctgagctgggaggatctaaaaagttttttgttttttttttcttaaatctaggtagatactttgtggttcccgagactcacatgagacactcacatcagcgcttgtgtgattgtaagggcagtggccttacatgtggccacacagccaccgtcagggcctcctatttctccagaattctgtctcacctctccaatccctctactccatccacagacaataagatctttctaaacacaaatttatacacaacaattccctagctgggctcctgggcagctccccatcaccaactacatgctgagcccaggaatttgagaccaacctaagcaacaaagtgaggccctgtctctacaaaaagtaaaaaataagccggacatggtggtgcgcacctgtggtcccagcaaattaggaggctgaggtgggaggatagcttgagcctgggaggttgaggctgcagtagtaagctatgattgtgctggtgcactccagcctgagtaatagagtgacaccctgcttcaataaaaacagcaagaaaagaaaccttgggagccacaaaagaggcggctgcagtaggaatggacgatagagcatggatcctactgatttgaagaaggtagaaatagaatgtgaagtggatgggttccagtgggtggagtttgtgggtgtagtgtggactggctggctggtacagttccgctctttttatttgctcttgaaatggatatacttttcattagtgagtctcatgtgagtttcaggagtcacaaagagaccatctacccagattaaaaaaaaaaaaaaacttaaaacatgctggccaggcacggtggctcacgcctgtaatcccagcactttgggaggtcgaggcgggtgggtcacctgaggtcaggagttcgagaccagcctgcccaacatggcgaaaccccgtctctactaaaaataacgaaaaatgagccgggcatggtggcgggtgcctgtaatctcagctacttgggaggctgaggcaggagaatcgcttgaactcaggaggtggaggttgcagtgagccaagatcttgccactgcacttcagcctgggtgacagagtgaaactctgtctcattgttccattctgaagagctgtggaagactcttgagatggataagaacatgtcctcattatcaccctgtggagttctagagctagagttttaacaagatagcatgtggattacacataggaggtgtcctccagtttctgactctatcctcctcttattcaaatgactttaaaaaggaattttgaaggctaaggtgggaggatcacttgaggaaaggagttcaagaccagcctggtcaacatggtgaaacacccatctctaccaaaaatttaaaaattaggcgtggtcgtggatgcctgttatcccagctacttgggaggctgaggtatgagaatcgcttgaacccgggaggtggaggtttcagtgagccaagatcatgccactgcattccagcctgggtgacagaacgagactttgtctcaaaataaatcaataactcaataaatcaataaatacaaaaataaggaggtattttggtcatctacaatacttgtttcaggagagctgaagtttgatacctttttctaagtctaaatatatggaaaatggccaggcacagtggctcacgcctgtaatcctagcactttgggaggctaaggagggcagatcacttgaggtcaggagtttgagaccagcctggccaacatggtgaaaccctgttttctactaaaaatccaaaaatcagccgggcatggtggcagatgcctgtaatcccagctactcgggaggctgaggcaggagaatcacttgaacccaggaggcagaggttgcagtgagccgagatcgtgccactgcactccagcctgggcgacagagcgagactccgtctcaaaaaataataataaataaatacataaatatatggaaaatgccattccagtaaatatttggcattgcaaatcaatgctttaactgtgttctaggctgggcacagtggctgatgcctgtcatcccagcactttgggaggctgaggcaggtggatcatttgagctcaggagtttgagaccagactgggcaatgtggtgaaactctgtctctacaaaaaatacaaaaaattagccgggcatggtggcatgtgcctgtggtcccagctactcggatggctgagtcaaggggatggtttgagtcagggaggtcaaggctgcagtgagctatgatggtgtcactgccctccagactgggtgacagagctagaccctgtctcaaaaaaacccctgaaacccttaaacttgtcacatattggtgggtgtgactgcagagaattgtcatgccttcagaggccgaacaggaaacagctgaagaggagacagtcgccgagaacaagtttgaattttacccagctgtcggtatatttttcaggtgcgtttattgttcttgactagtactttttgtattttaaaatgttgatgtaatttcaaactgacggaaaacctgtaagaatagtatcatgagcttccctatagcctttgcccaggtttgcagattgtttacatctcgccttgtttactgtcaccctccatttacatattcagactgagctggagatgctgtcccccttctactcctaaacaccgtgtctgtctccttagaggaggccattttcttacgtaagcacagtgcagttgtgagagtcaggacctgtatcatggatatgtgctcccggccctctgtagttcagaaggtcaggtgttgctgcctgcccagcaatgccctcattatgccccgcccgtcacccaggatcacacgttgcatttggtggtcgtgtctgtgtagcctaccttaatctaaagaagtctctcagtctgttttagactttcttgaccttgatttttttaactgtgaatttaccatctcaaccatctttcagcacacagtttagtggcagcaagcacacccacatgcttgtgcagccaccaccagcatccaccaccagcagccatctccagcagctttccatcttcccagactgaaactgtctccattaaacaccaactccccattccccttccccagcccttggtaaccgctcttctgctttctgtctctgaatgttttggccttgcatgtagtagaatgtcctgaatttgagctgcctagtctttcctcatattcacactgagatggggcattttgggtaatgatgcacctttgtcagtgaatcccatcaggagcacacgacggtgctttgtcccagtactgtcatgctcatttgatccattaccttcaagccgtttcttgctgagtggtcgcctcctgactgatgctgcccttttgccatacctgtttgggagcacgtcctgactttccagcacaaccagagggcccaagctcactctgtgccctccctgccccagtcctggaattagccttttctccaaggagcctggttcctgttagtggcgaatggcattgagaagccacgaacgtgtgcatttagagctgggctgtgtgctttgcccttggtgtggcatgcgtctcccgttggttggccctctgagcaggagagagaggatggcgctctgtcttgtttacctctgtttctctgtgtatgctggaaccatggatgtgtagagagagctccagtccagctcctcaccatgatatgttcagcccttcccactttgcctgctaccactccctacccagccatgggaaaccagctccattgtcctcatttaatcatgggctcaaagctggaatgcacagaagggagcctcggaatggctaacgctggccacttgggaaagcaaatgctgcaagaggttgacttccttgttttctgaggtaaacgttacatatggtgaaatgcacagaccccagctatctgaacaattggctcatgctgtctagaaatgtcagcattagtcagtgttttgtgggaaatcactgttgttttacatagatggcactgcacgtagggtgcatggggtgaaggggacggaagacgtggtcatggccctgtaggaatttacatcttataagagaaaaacaacatccttacccacagctgagtgaaaagcacagtgcagtcatgatctgcccttgagtaacaaggtagcgatttcaggaattctgcagctggacattgagatggtgtctgttctgcaccagagacttggctgagctcctagctggatgggctgtggagtccatggtggctggacgaagatctgtgtgctcaggtggagtggttgcgggagcagggcggaggatggacaatgaattcacaagtgactgatgtatagaatttagtcattcagctactatcatcgagccccttctctgtgctgggcactgggctaagtgctgcggataccatggggagtaattcctgcgttgaaggtgttttccagtctatcagggcagatggatgacagtgcaggaggcagggtgtgaggtggtggtggctggatgggccggacggagaaaggccttctggaggtgggagctctaagccagtagctgaaacagaatggaagggagtggggtggaaggttcagctggaggaacggggacgtgcaggagctgagaggtgagtgagcagggtcttcagggaaacgccactgggggcctcctgcaaggggccttcccttgtgctgtgggagccgcctcatgcccacccggtgctctgtgcctgccattcccttcccacactgccactccccagcacttggctacgtgttcgttttgtctccccactaggatgttgtatagagaacagggactctgtgttcactgctgagcccgaggctgttcccggggtgactggcggtcaataggtgatcaataactgtttgttgagtcaaggaagggagcagagaccctgagaagagaagaactgagagatctgtgagccggggggctggacaggacagatcctgaccggcttataaggccacaggaatttggattttatcttaagcacaagtaagaaagcttttaaagcagggtggtgacatgttcagaatggcattttattttattttatttttgaaatggagtctcactctgtcacccaggctggagtgcagtggtgtgatctcggctcactgcaatctccgcctcccgggttcaagcaattctcctgcctcagcctcctgagtagctatgattacaggcacctgccaccacacccggctaatttatatatatatgtatatatatatgtatatatatatatatatatatatatttagtagagatggggtttcaccatattggccaggctggtctcaaactcctgacctcgtgatccgtcagcctcggcctcccaaagtgctgggattataggcatgagccacgcacccagccctagaatggcattttattttatttttatttttagtttttttgaggcagggtctcactgtgtcactgaggctggagtgcagtggcacaatcaccgcttactgtagcctcgacctccctggtctcaggtgattctcctgcctcagccttctgagtagctgggactacaggcatgtgccaccatgcctggctgatttttgtatttttttgtagaaacagggttttaccatgttgcccaggctggtcttgaactcctgggctggagtgattcaccacctcagcctcccaaagtgctaggattacagacatgagccaccgcacccagcccaggatggcattttacaaagatccctgtggctgcagactggggtgtgtgagaatgtgtatatgtgtctgagtgtgtacgtgtgtttgtgtgtgactgtgtgaatatgtatgtgtgagagactgtatacatgtaagtatgtatgtgaatatgtgtgtgtgtgagtctgtgtgtatgtgtgattgtgtacatgtgcttatgtgtatgcatgtgtgtttatgtctgtatgtatgtgtgtacatgtttatacgtatgtatttatgtgtcagtgcatgtgtatttgtgagtatatgtgtgtgttagggaggagcatggtgtggggtggggagtctcttgagggtaggaggagatgagggtctggtggcggcttgggctggtagtgacaggcccggcagccccaagagcccctggaagcagaattgcgacccttggtgactgcttgggtgcaggaggatgcagggtgacacgcagcctcctaactggatgtaggagagaaaaacaagatacaccaggcatttggaaagccaaagaacacgtgtttgcttgtgaaaacttaaggaatgttttggtgggatatgttgaaattgttgcctaaaacgatcgctgatcttgtgcccctcagtgtgtggccttcgtttacccctgcttcccctcactcccctgcttgggggctgggtggtcatgacagcctccccagtacacagtgagcatcttttagtttgatgttttcttggagagctttttattttatccttaaaagtagatcagacaaggccgggagcagtggctcatgcgtgtaatcccagcactttgggaggctgaggcggacggatcacttgaagtcaggagttcgagaccagcctggccaacatggcgaaaccccgtctctactaaaaatacaggaattatctgggtgtggtgacgcacacctgtaatcccagctactaaggaggctgaggcaggagaatcgcttgaacctgggaggcagaggttgcagtgagctgagactgcgccactgcaccccatcctggcaacagagcaagactcttgtctcaaaacaaaaaacaaaaacaaagtagatcggacaagcagtttaaagatatatcaaaacaaaagtactgtgaaaaagttaaatcagatttttcctgcattttctgtaagtccttgctgaggtccagatttagttttcagctaggtgtgaccgtcgcctgccttgctgccgatgtcctgaagatgcttcatgttggcacatgtggcttcatcgggtgggctaccatcctgcatcaatagtgggccgtttccatggtttctggtctgttgctggtctggcttggcaggtggcagagcctgggtcagacccgcagtttggcctcagggctcaggctccagagaaccactgtgcagccttttacttcgtacacacagctcttttcaccaagatgtgtttttactgggtcagcaggcatgaatgttttccctgaagagtttttttttttaatttttatttttgagacagggccttgctctgcaacaggctggagtgcagaggtgtgatcatagctgaggaggctgaggcgggtggatcacgaggtcaggagttcgagaacagcctggccaacatagtgaaaccccgtctctactaaaaatacaaaaattagccaggtgtggtggcggccgcctgtagtcccagctacttgggaggctgaggctggagaatcacttgaacccgggaggcagaggttggagaattgcttgaatccaggaagcagaggttgtggtgagccgagactgcgccactgcatttcagcctggataacacagcgagactaagtctccaaaaaaaaaaaaaaaaagataataaataaaaaataagggagataaagttctgttttctttttttgttttgaaatcaagatatttgttttagtcaggttcttttggttgcaaagaagagtctcacttaaatgtccctaagcaactatgttgcctaaggatgcccagtgcatcttaattgctggatgagttgccacaaagtgaacactctcacaaccagatccagaaacagaacagccccgccttgaagatcctctgtgcccccagtcgtgcccacccctccccaggaagctgtgctcctgatgtccagggttgtgtgaccttacttttgcttttggtttctctcgctcagcattgtctgtgagattcatccatgctgctctagtagccatgctcattcacccccttggaccgcagttaactcacctgctgatggacatttgggtggtttccagcatttcggctactaaaattgtgctgcagggaacattcacatgtcttttctttttttttttttggagacggagtctcgctctgtcgcccaggctggagtgcagtggtgtgatctgggctcactacaagctctgcctcccgagttcacgtcattctcctgcctcagcctcccgagtagctggaactacaggcgcctgccaccacgcctggctaattttttgtatttttagtagagatggggttttaccgtgttagcaaggatggtctcaatctcctgaccttgtgatctgcccgcctcggcctcccaaagtgctgggaccacagctcgcatgtctttttgggaacatgtatctaatatgtctctggtgttgattcctaggggtggaattgctgggagatagagaatacaaatgttcagctctaggagataccgccacacccttcttattttattttattttttcatattaaaacaacatttattttaggtttagaggtacatgtgcaggtttgttatataggtgaactcacgtcacagtggtttgtgtacagattattttgtcagccaggtattaagcctagtacccaacagctttttttttttttccggatgtgcaggtttgttatataggtgaactcatgtcacagaggtttgtgtacagattgttttgtcagccaggtatcaagcctagtacccaatagctttttttttcagatcctctccctcctcccaccgtctaccctcaagtaggccccagtgtgtgttgttcccttctttgtgtttgcatgttctcttcatttagctcccacttataagtgagaacatgcggtgtttggttttctgttcccgtgttagtttgctaaggataatggcctccatgttcccacaaaggacatgatcttatttttttgtgtggctgcatagtattccatagcctatatgcaccaccttttcttttctatatgttgatctctggcatgtaccacattttcttatctgatctgtcattgatggacatttaggttgattccatgtctttgctattgtgagtagtgctgcagtgaacataagcatgcgtgtctttatggtagaaggatttctagctttgtgtgagagtcccagttcctccacatgcttgccaatacctggaacgcatgttatcttgaaagttttgtagaaaaacacctacagtccttacccttgagacttgtacagataatactaggaagtgtctcttacatgggagagtctttttgtaactgttggatgactgcgccaatgccatcaatgactttgtgaggtttggtggaataaggagcttggtagaagctggattgctgcggaataattgttaagaaggcaaagggaaggggaggtggtggtcacacaccatggggggtgtaggaggagcaaggtgggctggtgactgaaggaggccacagtaaaacaatgttttctttgagaaggagccagtgcaggggagagtcaaggcaggggagaatgtggtgaagcaagcggcactgctgaggaggggttagagccccagggctgggaggcggagggaggcgtgcactgctgtggaggggttagagccccagggctgggaggcggagggaggcgtgcactgctgtggaggggttagagccccagggctgggaggcggagggaggcatgggtgtgggagctgtctcgctctgtactttgtatctctttataatttgcaaacattttaaaaggtggattaatttccctaatcctgacaaaggccctagcaggcttattttgttacagttgagtaaactgaggctatttggagagcacagccaaccttaccaaattctttgggtgttaagcggcgagccaggagctgcatctagcgctgggacagctttggtgcccggtttctacactgctcttgcttagttttgagtgcagcctttctggcagtttctcattggtttaaagtccctccttatgtggagtcagacaactttgatggacttgaagaattgaagaggcaacatagtttttatctaagagaatgggatttggagtcccactgacctttctccaagctggttccacggctctctacctgtctgctcctggtctgagtctgagtgttttcatcaatcaagtgggtctaagactcctcctgcatagcgcagctgtagggattaagcaggataatattgagaaattccctgggactgcttgactgtagtttaagagcccaatgtttggtgcctgtctcatgccgtggtcagcttctgtgcagcaaatagagatagcgcggtaactctgtgtgtgctgttatggagaggtttcccagatgttactaagtaaaaacaatgcaaaacaaggcacagaacagattttatggtatgaacctatttgtgtttttaaaaaggtatatgtacacataaataaaataattatataaaaaatttatggaaggtatacacttatacacaggtatgggaggtaggggtaggtagaattataagaatgtatattttcctggctgggtgcggtggctcacgcctgtaatcccagctcttagggaggccgaggcaggcggatcatgaggtcaggagatcgagatcatcctggctaatacggtgaaacccctcctctactaaaaatacaaaaaaaaaattagcccagtgaggtggcaggcacctgtagtcccagctacttgggaggctgaggcaggagaatggcgtgaacccgggaggcggagcttgcagtgagccaagaccgcgccactgcactccagcgtgggcgacagagcgagactccgtctcaaaaaaaaaaaaaaaaaaaaaaaaaaaaagaatgtatattttcctgtacttaatttaaaaaacttctgcatgattattttagtgttagtttaaacagcaacaacaaaatattacccttatgatatgttctctattagcttattagctgtacctctttttttttttgagacagagtctcactccatcacccaggctggagtccaatggcatgatctcggctcactgcaacctctgtctcccaggctcaagcgattctcatgcctcagcctctcgagtagctgggattacagatgcatgccaccacatctggctaattttagtatttttagtacagacagggtttcatcacgttggccaggctggtcttgaactcctgacctcaagtgatccacctgcctcagcctctcaaagtactgggattacaggtgtgagccaccatgcccaacctatacctttttgttttattttatttttttttttggtggtggttctaagattttcaatattacatctttaagttatcacagtgtaccttcaaatgatattatgccacttcacatgtaatataagaaccttatagaagaagggtgtactgctctcccccgtccttttgctatcaatgtcatacattttatttccacacattttaaaccccacagtacattgttattacttaaaaaaggtctggccgggcgcggtggctcacgcctgtaatcccagcactttgggaggccgaggcaggcagatcacgaggtcaggagttcaagaccagcctggtcaacatggtgaaccctgtctctactaaaaatacaaaaaaaattagccgggcatggtggcgggcgcctataatcccagctacttggaaggccaaggcaggagaattgcttgaacccgggaggcggaggttgcagcgagccgagatcgcgccactgccctccagcctgggtgacagagtgagactctgtatcaaaaaataaataaaataaataaataaataaataaataaataaaagtccattatcttagaaataaattttaaaataagaatatctcttatattaacccacatatttctatttattttttctttttttttattctgagacagagtctcactctgttgcttcgtctggagtgcagtggtgtgatcttggctcactgcaacatctgcctcccgggttcaagcaattttcgtgcctcagcctcccaagaagatgggactacaggcatgcgctactatgcccagctaatttttttgtgtttttagtagagatgggatcttgccatgttgaccaggctggtctcgaactcctggcctcaagcagtctgcctgcctcagcctcccaaagtgttaggattacaggaatgagccactgcacccagcccacatatttctgtttctaggcttcattccttttatagctctgagcttgaatctggtatattttccttcagtctgaagaactttaactttgcttatagtactggtattttggtcacatgttttctcagcttttgtttgtctgaggttgtccttatttcacctttatgctcctagcactttaaggatgttctgttgtctcaggcttgtcttgttcctgaagtctgctgttggtcttacttttgttctctagtatgtaatattctttttctcctccagctactttaaagatgtttttgtcattggaatttagcagtttgattacaatgtaccttggtgtagttttctttgtgattagcctgcttatggtttgttgacattcttggatctgtaggattatacttttcaccaaaattttggaaaatgtactgccattatttttccagttttcctatctctccccttgttcctcctcaatcttccagagctctatttacatttattttagatgctagatattgtcccactgaggatccccattccctccatctttttttcctctgtgattcagttgaattgtttctgttgcaatgtcttcgcgttctctcatctattcttctatagtatctaacatgctctttattttattgttacagagacaggaggatctcactatgttgcccaggctggtcttgaactcctgggctgaagtgacctcccatggtgtcaggattacaggtgtgagctgcaatgcccagccctaccatgctcttaagccaactcatccgatgtatttcaaaatttcagatgctattttttttctttaaaagttccatttggatttctttcttcgtattcatgctctcttttaaatccttgaacaaatttgtaatattgttttaaaaatcttatctgttatttcctcgtcactctcatttttgggtctagatggactgactttcttgtggttgtggatcaggctttcctgctttttcttacctctagtaatttctgattggatgctggacatagggagtgttacgttgttgagcatctgcgttttgttttctgcatttaaacagtgttgagttttgttctggcaggaagttagtttacttgtagatcagctgccttcttatagggcttgtttgctgtcttttaaaaacaggtctaggccgggcgtggtggctcacgcttgtaatcccagcactttgggaggctgaggcaggagaatcgcttgaacccgggaggtggaggttgctgtgagccgaggttgtgccattgtactccagcctgggcaacagagcgagactctgtctcaaaaaaatgaatgaatgaatgaatgaataaataaataaaagcaggtctaggtcaggattggaaaactatggccccttgcttgtttttataaataaagtcttctggaacacagtcccattgtttgtggatggtctatgttgatttcatgtgacagtggtaaagttgagaagttgaggcaaaatctatatgtcccacaaagcctaaagtatttattatctgcccctttacagcaggaaatttggtgacccctagtctagagaagcctttacttttggtctagtttagccctgtgcctaacgttgtggcctttctgagtctccgtgagggtcgtgggtgcttcatgaggtcccttaattcttcctcgttggagcttgaatgtttctcaccctgctccgcttctcctgcccctgtggctgctctttgcctggcctcctggagtctcaccagcagcacgccctgccttgccttcaggcagggactcaaggagcccagctccgtttctgcctcctccgtgtggctgtctcctccttgttactctgccgctctcattctggctgctgtggccatcatgaactcagacctctctctcctcagctcagtgactgtcacggtctgcatgggcccctgtctccatgcagaaagctcctgtgtcacggggcacacctcatttgtcttcccgctcagggaccacgttcctgtatgactcgttgttcaatgcctgaagaagtgttttatgtattgtgttcagttttctagttgtgtatggtgggagggctaggctgttcctacttagtccatcttttcctggaagtggtagtccccccaagtatgatatagaaggggcaaatgaaagaaagtgccagatagatgaatgatgcgtgacgggatcaccttttattaagtaggttagagtagctgatggttgatttttttatttttattttttatctttttgagacagagtctcactctgtcacccaggctggagtgcaatggtgcagtctcggctcactgcaacctccgcctcctgggtttaagcgattctcctgcctcagcctccggaacatctgggactacgggtatccaccaccatgcctggctaatttttgtatttttagtagagatggggttttaccatgttggccaggctggtctcaaactcctgacctcaagtgatctgcctgcctcggcctcccaaagtgctgggattacaggcgtgagctaccatgctgggcctgatggttgattctttacagtgaataagttgttatgtattaatgagttgttctttcactgaacctaattatcccccccagtggagtttcactttccaacttacacacagcattaatatttaagattacattggtgtatcacattaatagtacagattaaagtttggaagagttcagctttcatgatccctagacaactaatttgcaaggctagatttagagtttctcctttctctgatagaaacatttgcatttcacttgggctttataacgccaggtaggtcagaggttgaaactgaaataattgttaaacacgtaagaggatttaaggataaaatcctcccctgttttggtgttacagatctaaattgggcactcagtcatgtagtgccagagtgcgggatttggctggctaccttaaaggtttagttaattatacagaaatcctctttcagtgttaatcattgttcatgtcctatagaaaatggtctaattgttcttttcatttagctattttgtttaagaaggtcctttctagtctgatttgatttctttcttttttgaaattaggaagtaaagaatacagaaaacatctatttacaattccatcagtatttataaaaacatctgtgtgcccccagcccagtcaagatatagaatatttcagtaccctaggacttctttatgtgttgcaccttgatcccagttactccttttcttaaagaggcaaatacttttcttccttttgttggcaataattatctcttcacttttcttttgagatcgggtctcattctgtctcccagactggagtgcggtggtgtgatcatagctcactgcagcctcgacctcctgggctcaattgatcctctcacctcagcttcccgggtaactgagactgcaggtgcacaccaccacaccaagctaatttttgcattttttgtagagacagggcttcaccgtgttgtccaggctcctctcaaactcctgagctcaagcaatctgcctgccttggcctcccaaagtgctgggattataggcatgagccactatgcccagcctcttcacttttcttaatggttttcctacctgtgcgtctctaaaagttgtacttgcgttttcgtgtgttgcttcttttctcagtatcgtattgataagaatcaggtggttgagaaaaacatttaggtatgctgtagggatagagtaactattttaaattcttttaaacaaaaaaatcaggtgcttgaatatatgttgtttacttctatgtaatatctcatttcatgtgtacatcacaatttacttatccattctactgctgaacaatgttgaaattagcattacatatttattttagagactgcgtctcactctgtcacccaggtgggagtgcagtggcaccatcacggctcactgcagccttgacctcccacggtcaggtgatcttcccacctcagcctcccaagtagccaggactacaggcaggtgccatcatgcctggctaatttttctttgtatttttttgtagagatggggttttgccatgtttcccaggctggtctcgaactcctgggacaaatgagcattcttatatattctggtacacctaagcaggcataggatataagataattatatattttcttcttttttttaaaaaaatgcctgttcaagtcttttgcccagttttctgttgagttgtgtttttcttactgattttaggagcttttatatattttgaatatgtattataaatacctcccagcctgggcaacatagtgaaaccccatctctcaaaaacaaacaaacaaaaaaagtagccgggcatggtggtgcacacctgcagtctcagctacttgggaggctgaggcaggaggatggcttgatcccagcagttccaggctgcagtgagtcgagatcgcaccagcacactccagcctgggtgacagagtgagaccctctctctaaaaaaccaaaaccaaaaacaaatctcaaaatctttccactcggaggcttgttttttcatgttccttatggggtcttttgacattctccattttaatatggtctgataatcagtctgttcctttaaaggttggtgctttttttgcatcttatttaggaactctctttctcccttgatggcatgaagttaatctgtattatctgttaaggctttatgctttttctttcctgtttaagttttgtataaactttgtgtatggtttaaggtggggatctagtttcccatgtggatatctagttgtcttagtagatttttgtgaaaagctcatccttcttcctcagttgcagtgctctgtcgtaggccaagtaggtctgtttgggacttgctgtttatcccattgatctgctggtgtcattggtcagccctagcaccactctgtctgctttaattactagggctttataaaaaatgtgtgaaggaagcacttgtttttcttgagaatgtcttggctattcttgttcttttgttcttcatataggtttaacaattagcttgacgagttcaaagaaagaaaatttggggggtatttgattgggattgcactgagcctatacatcaatttggacagatttgatatcttttcagaattgagacttctggtccacacacatggcatatctcttatttagataggtcttctttaatttccctgaattaagttatatgcttttccctgtagaggtgttgcccatcttttgttggaattcttttaagtacttgatattattttgatgctgtcctaagaggcaactttaaaaaatttaagtttttagcctgttatttggtaggtatataagagtaaaaattattttttatattgctttatatgcagcattcatgatatctccatgtcatcaggagccctggcagccatgcacacagcttcctgcccccttgatcctgaagagtgtgtaaggctgctggggatcggatgcagttatgtaaggggtgtggatgcagaggagccagccgtggtttcatgctggtcttgagtgtcattctaatcatgaggccaccttacacccctctactccaggacatcccacagatcagaaggctcatgggaacccagatggagaaccagctcctagcactggccttccccatttatcttaactggtgcatttccagggcagcagggctgcaagagtcagccctacagctgtctgcccacatgcctgggtcgggggaagttttgggcttcatgtcaattcttgagttcccgagagttcgtgtccaggttgggaataacttgtcccacaaatgcctggtagaacttgcccataaggtcatgtaatccgaaagtgttgtttgtaaaaaaatttttaaagttctgatttaagcttttaagatggttttttttttcttttttctttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtctcgatctcctgacctcatgatccacccgcctcagcctcccaaagtgctgggattacaggcgtgagccaccgcgcccggccggttttttttttctttttgagtcagttttggcaagttacattttaagaagactttgtctatttcatctaggtttcaaatttataggcataaagttgtttgtaacatcctcttgtgatctttttaaagtcaatgggactgtagtaatgtttcctttttattcctgacattgagatttgtgcgtccactcttttttgttgttgtttttttgagacaagatcttgctttgtcacccaggctggagtgcagtggtgcgatcatggctcactgcagctttgaactcctgagctcaagcggtcttccccgcttagcctcccaagtagctgggactacagatgtgtgccaccaagcccagcttatttaatttttttttttttttttgtagagacagggtcttcttatgtttcttaggctcatcttgaactccttggcctcgagtgatcctcctgccctggcctcccaaagtgctgggattacggatgtgagccaccatgcctggccccctagtttattttatatcttattatttccttttttctactttccttgggtttgttttattaccttttccgccattcttgagggggagattcttgagatgagtacttaccttattagttttcagccatttgtcttttctagtgtatgcacttagcatttagaaatgtaaatgcttaatggcattcaacaagtagtagtttttaaaaatatatttatgtatttcagagacgaggtctccctgtgttacccaggctggtcttgaatcctggctccttccgccttggcctcccaaagtgctgggattataggcatgagccaccatgcctggctggatatacagtatttttgttcagttcaaattattctctaaattttattttgacttgatcaatttattatttaaaagtgttgtaatttttaaacatagaagactttttctaggatttatttttgatttcttaattgcattttgatcagtagacgtctgtcagcagggcagtagcaggtgcaccgcacgtctgtagggggagccatccacaccgttgccatgtgcgaatggcgccccctcgtgttgtggatggtgtaggttgcaccgctgtgtgcacacgtgtgcatacatgcatgcacacgcttggaatttcagctgctctgtcccttataggcccgtgcgtggtcagtttttgtaaatgttccctgtgtacttgaacacgatgcgtgtctacagctgttggtgccaccttttatacgtgtccattaagtcaaatattttatttgtggtgtacaaatcatttacactttactgatttttttgactgtttctatcagtaacagagaggtgtattaacacttctcaccatcattgtaaatatgtctattctccttattagacatatttagatagaattctctgcccatttgtgcttcatttatattttgaggccatattgttgtaaaactgttgtatcttcctggtaaattggagtctatattgttgtaaagtgactctttatccctaataaaactttttgccttacagtctgttttgtctcaggatagttacaccagttttctcttggttagtgtcagtcttgtttatttgtccttttatataagtcaacacttctgtagccttgtatttttcatatgtctcctataaacagcttgtagttggattaaaacagatcagtctgatgatttttgtctttcagttggagcacttagtctacttacagccattggggcctaaatctgccatctcttttgtgctttctatttgtccttcctgtaatgtttttttaaatgcctttttatagattgaaaatatttaatttcttcccttttactatttttgaagcagtgcactgtttttctcttgtaatggtttcttagaaattacagtaggaatactgaaaaaagtacaacgtccgtcatgacctttattcttttcttagacaacccaagacttaggaaattatttaatccgtttgtttcttgtatgtgagtattgctgtgtacagtattttatttttaacatcccaagttaccatccttgttttcggcagtcattgttctttcaggctgatgcacatgcttttgactcttcgctctcctttcctttagcgtctcagaactttcctatggggccacctactttgactgaaagacttcagaattcttttctcatgacggtctactgatgccacattcacttcgttagtctgaaaatatcttttttgtttgtgtgtttttgtttttttgagacagggtctcgctctgttatccaggctagagtaaagtggcatgaccttggctcactgcaacctccacctcctgggttcaagccatcctcccaactcagactgttgtgtagctgggacagcaggtgtgtaccaccacacccagctaatttttgtattttttgtagagacggggttttgccctgtggcccaggcttgtctcgaactcatgggctcaggcgatccacataccttggcctcccaaaatgctgggattacaggcgtgagctcccatgcctggcctctgaaaatgtctttattcagtcataattctttttttttttttttgagatgaagcttcgctctttttgcccaggctggagtgcagtggcacgatctcagctcgctgcaacctctgcctcccaggttcaaatgattctccagcctcatcctcccaagtagctgaaattacaggcatgcaccaccatgtctggctaattttgtatttttagtagagatgggtttcaccgtgttggtcaggctaatcttgaactcctgacctcaggcaatccatctgaactggcctcccaaagtgctgtgattataggcatgagccaccacacccggcctcagttgtcattcttgaaaggtatttttcctagggatggaattctagagtgatgttttcttttagactttgaggacagctgggacctacaggtgcatgccaccacacctggcaagttttacattttttttatagagctagggtcttcctatgtggcccaggcttgtcttgaactgctgggctcaagcagtccccctgcctcggcctcccaaaatgctggcattagaggcgtgagccattgcgcctgactctccagcttatttacagtcctttccacggaagtcactgaagaattggataagtgtacagtctatacttttcatcaagcaatagataaagaggtagcagcagggtgtcatggccagggtgtcaaactgtgtggaagctgcagtccagctctggagctgggcttcatgcccatctccagtgccattctcttcgaagggccttggacctgcagccttcctggagggagagggtgaatagccaagatgcagaatgggctttctttgtaatctggaagacctacgcttaatgaagcagtgtcagtttgaacacttcttaggcttatgcaaacatgtttaggttattttagctgattgaaggcaaaatatggcctgacgctgtgatgtgcggcgcagtcaaatgcgtcagaccctggctgtgttcacagagtgcagcatccagactgagggcggagatagcctctctgctcatgagctgtctctaaagaagcgccctctttaaaaagattgcacgttacattggaatttattcaaggtgcgtggctgagatagtgaagggatgcaaaccgtcatctgaggaacttaagtcagggagctgggttgtttagtgtggagtaaaggatctttcatgagtgagtggttgggggggtggtacatttcactccagatgtcaacagtcattgcgatgttggcactgctttggtcctgagtttcaagggaggaaattgaaggcttgagaggtgaagtaatttgcagaaggtcccctgaactcaggcctgactgtctccaaagtggcgtgtcagctgagggaacacagggtatcttgcagtcgtgatttctgatcaacacaagctgtccagcttcccaacatggccaaacaacaggacagacgtggctgctttccgtgggctctgttgcttctgatttatgtgtgtcttttctctttgagttgaagcattagaaggtgtatccaccaagatccagtaaagaagacagaaaacacaccaggtatctcaaccaagcggatttaggtggggaactggttttacaggctttcgaggggctgaaagggccaaaaggaaaccttgactgagacggtaactacaggaggcaggtgctgctgctagggctgggggaacaaatagaagaggctggagttacttaaatctagatggctagagaagggacccagtgagctggggcttgggccactgaggtagggacacagcctggcgcttgctggcaccgctgctaagtgcacagtgcaggggcctgggagcagaaggaagcaggagggcatgggggcggccggcagctgggaagggaaccatcctccctcctcgcctgccagcctccctggagggtgctggacaggtttgaacttcatgtggtagcagtaattttaaggttttgttttgtccccttgcaactctccttacttgctttgtccccttgcaacttataactaccttacacaggtactctgcattggtactctgcacaggtactcggggttattatttacatatgggatctgagcctcctgtgctttgcccgagttagggcctcaaggactttgtggatcccttcctgatcttttatttatttatttgtttatttatttatttatttattttgagatggagtttcgctcttgttgcccaggctggagtgcaatggtgcgatctcggctcaccgcaacctccgcctcccgggttcaagcgattcttctgcctcagccccctgagtagctgggattacaggcatgcaccaccactctggctaattttgtatttttagtagaggcagggtttctccatgttggtcaggctggtttcgaactcccgacctcaggtgatccgcctgcctcagcctcccaaagtgctgggatcataggcgtgagccaccatgcccggcccttcctgatctttatggcaagaggtttttgccacaacaacacttcacacctgactgaagcccagagaagcccacgtcacgatggctggaggcaaggaagaggatctagtcttttctctctcccagaggcgggagccttatgtccacatcactgtgagcctgctggccttgcccaaggactattcttttaaactaagagagtaaattaagatatttccgaggggtctgggatccatgtaaatgaaaaagttcaaccttttttgtaagccatgttcttaaaaatctgcatgtggggtagttaagtgtcacttactagagtcgaggatttcagcgcaggtctttttgaagttctgagatgaacttctcctcctctttatacttctcattccaaggatgctgagtgtgggattattcctgatgcagtgctgcctagggagaggagcctcagcacggcatctatcatgggctgctttgcttctgtatttagaaagagaactagaattttaaaataattgacttacaactacttagaaaagaaagggccaaatactatgtgcaatcatggcttcctcacggtcaggcatgtttcctgatctcatctcctttttcaggagactctttggaaatacatgcatatatttcattattgggaattaccaataatttaaccacttttgtgctattagacatttaggttgcttctgattttttaatattataactcatgttatgatgagacagtgtataaatctttgttcagatttctggttattttctcagtatggtttctggaagtgatagaaataactggataaataataaataacctttaggggaattggcacgttttgcaaaattgctgtttgggaagtttgtcccattttatgtgcccgctcgtggggtctgagggaggctttttcctggctcggctgccagccctgggcattgccatttgaaaatacctttgcaattaagtagacgcttgaccgtttcattgttttaattatacttttcgattattagtgtagttgagtatttttacatatgtttatgggtcagtttcattatgtttaattgtttatgcccttcgtccacttgtaagtaaaacagtgaagagtgacccgtgtggggttttttgtgttttgttttggagacagggtcccactccgttgcctggggtggagtgcagtggcataatcacagttcgctgtagcctcgaactcctcagctccagcaatcttcccacctcagcctcccgagtagctgggaccacaggtgcatgccaccatacccggctaattttttatttttattttttgtagatacggggtctccctatgttgcctaggctggtctcaaacttctgagctaaagtgatcctcccatctcagcctcctaaagtgctggggttgcaggcatgagccaccatgcctagcctgtgtggcctttcatactaggtgaatctgtggccacccacatcctgagaattgttttgttcctcttccaacctagaggaaggtccccttggaagtgtggcttggggctctgtgattgaacctttcctattcatcattttcgtcagtgtgttggatacagatttggaaggcgtgattactgagtgctgatgatataaagctgggaaggacaggtactaatgtagatgaaagactcgtgatttactccaatcttgaaaggatgacatgctggcagattgtggtaaaatataacagagatactttgaaagtcctgcatttagtcttccctttctctcccttgctcccttcctcccttgctttctttcttccttccttccttccccctttatttgtcccatcaattgcgtaaatgcaggtaaacatttagccattcctgtgaaagccgctgtgtatgtggtggccttaatcattgtccatttttgggcctgtggatccctgttattctctgcagtggagactgcacatcgggccagtgcatgcctgctattctctgcagtggagaccgcacatcaggccagtgcatgcctgctattctctgcagtggataccgcacatcgggccagtgcatgcctgctattctctgcagtggagaccgcacatcgggccagtgcatgcctgctattctctgcagtggagaccgcacatcgggccagtgcatgcctgctattctctgcagtggagactgcacatcgggccagtgcatgcctgttattctctgcagtggagactgcacattgggccagtgcatgcctgctattctctgcagtggatactgcacatcgggcctgtggatccctgttattctctgcagtggagactgctcatggagcatctgattttcttctggaccttctattttgagctgcattcacagagcacacctgagaaatggtggccaaggggagtgatctaggaccctgagaaacctggaagcagctccccttagggagagttgcagagggctggggatgttgaaggagagagaaggctctggaggaacttggatactcctttccaggctgagaagtgctgccctgggcactagagagggagagctctggccatggcttctgagggccagctgcaagtggacactgccatgggacaaacagcctcatctcactcattgaacattccaggaggaactaaatgacccctctcaggatgtcacgggatttctatgttgctggaaagatgcttgtggtggaagcgtggttactaggtggacctggattcagaggacagctcagctgattcctggcttgtggacttagatgggttgaacctttaaacactcagaacatcagtttcctgtaaggtggggtaagaatgcgtgtgtactgtgattgatgtgaataaaaggagcactgttgccaagtccctgagtgcagacccagcaggttggaaccacttcttttctgttccctgaacaattggactgtgtggacgcagatcctgcttccctgagctgcacggccctctctgatcgcacatacatgtgtgcatctgacacatatgcttgagtgtgagggtgacagcggtcagacaaatgggcttttttttttttttttttttttgagacagcgtcttgctctgttgcccaggctggagtgcaatggcgtgatctcggctcactgcaacctccgtctcctgggttcaagcgattctcctgcctcagcctcccgagtagttgggactacaggcgcccgccaccatgcctggctaatttttatattttcaatagagacggggtttcaccatgttggccaggatggtctcgatctcttgacctcgtgatccgcccgcctcagcctcccaaagtgctgggattacaggcgtgagccaccgcgcatggccaaatgggctgttttaaatctattagaaaaatttttcacaatttttagtctctattattctttctttttttttctttttttttttttgagacggggtcccactctatcacccaggcttgacagagtgcagtggtgtgatcttggctcactgcaactttcacctcccaggttcaagcaatcctctcacttcagcctcctgagtagctgggaccccaggcatgcgccaccacgcctggctaaatattctcagttatactttcagtacacataaaggcagttgtcaaccaagctgtttgttagaaaatgctaactgtggtccctgtccactgcctctttcctgttttttttttttttttttttttttgagacagagtcttgctctgttgcccaggctggagtgcagtggcgcgatcaccgctcattgcagcttctgcttccttggttcaagtgattctcccctgcctcagcctcctgagtagctgggattacaggtgggcaccatcatgccaggctaatttttctacatttagtagagatggggttttgccatgttggccaggctggtcccaaactcctgacctcaagtgatctgcaagccttagcctcccaaagtgccgggattataggtgtgagccactgcgcccagctgttcactgcctctttctgaggcctgtcccacgtgggaccttgtgagctggtggaggcctcttgagggctggcaggagcctgtgctacctctgggcccagcacctatgctcccgggagccgtcccgcctcttgccttcagtcttcatctgtactgtgaggatcatccactggcctcccaacccggtagtgaagggggaataacaaggacgtctctggaaagtgctgcaggttcccctgaggaaagctattgtagagtagaaacgagaatgcacccccggaatcagctctccgatgatatgcaggtgcagctgcctccagccctgccgttggtcaggaggaggcaaggggtacctaatgtgctcttatttggcccatgatgagtggagaaagagacctttgcccaggtgtccatgtcactgaggcagtggcggagggtgtcccccagctctgcagtggtcaccctctgcctcctgtcctcgggcagctgcctgtggctgcaggcggtgaaggtgctgttggttgtttgctcccagacctggctgtggggcctgctctgcagaggtcaggggcatggcgcagggggacccagcagggagctggagccaggcagtgcgggctgagccaggccgaggagacccccgcttttatcttgagtgttgtcatctgatgctgagttctttctcagcagtgaaggggaatcagtgtcctgacttgaattgcactttgatggggtttttagtttctgtgtgttggatttttactgagagctctagagaaactagtcacctgggggtttcagaggagggttgtgaagtgctgaatttttctttgagcttttaaggtcagaactcaggggagctaaaaaaaaatgaaaaaataataatttaaaccttataaggtgactcataaataactgcctttcaagatgagtggaattcttctgggaaaaagccctgtggaaattctcctgaccaccgagaacaaagaggaccactgctataaaaacctccagaatcatcatctgcggatggagggaagactctgccaggagtgcgatttttcctttatgtgttactccgtttaccatgtctcaataaaatggcagagaaagtccttttcctgtgtttcatttttcccacaacctttccccttttgacttctttggggcttccccttatctgagactggcccaccgcagaattcagcttcacgggcctgtccggatggaacgtggacgccatcatgtgtttactgcttttatctcttagccacttagaaacattgttaccatgagaaaatgggaattatgctttgatccttgagttaaatcgaggctgtggtagctggtgagttatgaggctttattaaaataaatgatcttggatgtgttgggtattcactggcaagatgttaccagaactcaaacatttaagataagccacatattatttgtatggattcataaaatatagaaagagcgtgagctggctatggctgggttttgtatcctttcccccaactctgttacacttttctgaaagaaaatgagactttgcttttatgtgaatagctgtagaaagctagggaggggtgccatttggaaattgaattaaaaccaaattatgtaagaatgtggttagttttataatatcctgttcttgtttcagtgctttggtttattattattattattattattattattattattatttttgtttttttttttcctgagatggagtcttgctctgtcgcccaggttggagtgcagtggtgcgatctcgactcactgcaaactccgcttcccgggttcaagcgattctcctgcctcagcctcctgagtagctgagattataggcacgcgccacctcgcccagctaatttttgtattttttagtagagacagggtttcatcatgttggccaggctggtcttgaactcctgacctcatgatccatccgccttaacctcccaaagtgctgggattacaggcgtgagccaccgcggctggccggtttattattttttcctcagtgccgtggaggcgcacagggctgctgcacccgttagggtggccctgggtcctacagccccgggcacacggtgcacagcacttgcgtagggtggtcctgagtgtgcacgctgctacgtcgctcaggcttatgtgccttaagcagttgcatagtttaggcacagtgctgcttctcaaagtgaattctacttggagccacttatatatagattagattttataatgtgtaatatgaagaggagcctggaggtatacttaatttaggaattatattatttttggtttgggttttaaagtatttgaatgcctgttaaaccaattctgtagtggctagaggttcaaaatttgtagtatttatgaaaaatactcattctaagtctgcttccttttataatttaggtatatacactctctgttcagaattcctcaatacaacgcattaaatattgttccgaggtcttctgagccccgttctcagtggtggccgtgagctaacatttccacatctgtcacaatgttgtttgcagtttgtcgggaggcgctctgcagccaggcagatggaggggccgctaggcaggatgttgcgagtctgtgagggcatcaatcccccgtttctggcatagatttaattgtttggttcaactgggaagccatatattaacttctacttcaacccatcctgatctctccacagatgctagttttatacaggcctatttttctctgaaattgagcctgagagacaaaaatccacacttgggctgtcatagattttggtaaattgagtcttgtgactgattggtgcctcctgcctgccccgtgatcctgtatgtagtaaccacgtcgtgatcacaggtcatggattggggaaagttgcctccaaagatgtgggtgtctgtttttcactccactttccatttggccaaaaattcaacacttcagtttctgtttcaaaaaagtaacaaagaattaaaaggaaaaaagcagtaagaaagtttgggccatggtggtgctctggtacccgccttcctgtttctgcctgtgtcgctctggctgggcagggtccgggcatggcagccctcccctctctcctccccctctgccatgggggcctgtggttcagctgccaggcgggaactgaagagcagccccgggcgctgcagcttcctgtcctgcccatcacggtcagggacgccggtgtccgttccttctactccaagtctgtcccgagtttgaatgttcagatgccaccagcagctctttagggtctggaccaaacgtctgatttttcctctactaacctgatatgtttctcatggcctttctcgcctttttgccatgtgtgatagctgttcctgttccttggactggattttcacgggctcgctggcaagcaggtcctgcatagcatgctcagcatgtagctgtgctccgcgtctgccggatgaacacacgagccggtcatgggccacgtcagcaatgttctcgacctttgtaagcttcgagaatgtgctgtgtgtacagaaggacgcgcagccaagtatgcggtggaatatccagaaacaacacggggcttgtcgggtgcagacggggcgcctcaccggcccggcgcagccccgctcgcccctctggcctcccccgcagttcccctttcctggttgtgcagcatgcactcgcttgcctttttcttttctcacagttttatcaactgtttgtgcatccccgaaataatacagctttgcctggtgtggaaacgtatataaacattatcatagtatctgcgctcttttgtgtcttgtaagacacccgagatcgattctgttgccgtgtgtagcggcggttattcttgctgttgtcgtgagccattgaatacagtgtcgaacacttgggttgcccagtgtgtgtgtatgatgaatagtgctgctataagtgtttttatatatgaattttggttagcacctgtgtggattttcgggaggtagttgcctaggagtggaattgcgtagtaatcgggttgggttttagctgaggttgtttctgctgcaccacactccggcccacactgttacgcatttttactgtgttcattcctgtgggtatgtattatatcatggctgtaatttacttccccctggccccgactttgaaaagttgtatttatttatgagatacaatgtgatgttttgatagatatatacattggggaatgattaaatcgagcttattaacaaccatcaccacacatatgtatcttttttttttttggtggtgagaccatttgcaatctctttgcaattttaaaatatatagtgttattaactatagtcagcatgctgcatagtagatctctgaacttactctctgtccaactgaaggcttgtgccttttgaccaacatctcccctaccccttccacccactaacctctggtgaccaccattctactctgcttctgtgagtttcgtttttttagatttctcatgtaagtgacatcatgtggtgtttgtccttctgtggcttatttcacttaacgtaatgtcctcctggttcatccatgttgttgcaaatgacaggatttccttcttttttttaatggctgagtagtattccatggtgcatgtatatcacattttctttatccattcttttttttttttttgagatggaatctcgccatgtcgccccggctggagtgcagtggtgtaatctcggctcactgcaacctccgcctctcggggtcaggcaattctcctgcctcagtctcctgagtagctgggattacaggtgttcaccaccacgcctggctaatttttgtatttttagtagagatggggtttcaccatgttggtcaggttggtctcaaactcctgacctcaggtgatctgccctcctcagcctcccagtgttgggattacaggagtgagccaccacgtctggcctatccactcattttttgttggacaccttggtacattccatatctcggctattgtgaaccacactgcaatgaacatgggtatgcagatgtgtcttgaacatgccgatttcaattcctttggatatatatacccagaggcagaattgctggattctatatggaagttctgtttttcattttcattttcttcatgactaatgaaattacacaccttttcatactcttactggtgattttgttaggatcttttgtgatgtacctgttgaggatttttgcccttttcctgttgtattgtttcttattgatttgtaggaattctttaaacattctggataacgtccttttaaaatgtgtttatatgtggaacatttcttgtcctgtgaaacatctctgtgatgcaatatttcagtctttttatggtctctcttgataaacagaaatatgtagttctattctagtttaatgtgtaagtgctttccctgtgttttatgcttgtgttgaaatattttccaaccttaaggtcaagattttgtcccataatgtaccctaaaagcttcatagttttgttttttacatttaggtccctaacgagggtgactgccagtccctgtgtgcccagggcagtcctagggatgaataattaccatgtattaataatcacgccagtctatggcccatccggcattggctttgcatatggtatgaagtaagggcccagttttgctctgttgcatatgaattttaatttgtcccagctcctttcacttgcagggactatgatgactcctctgcaggccgtctttgcgggaactaagggctgagacgcgcctgggtctgtttctggccctttgtgctgttccgggggtacttctctctgtgtgccagcttcacactcctgtctctgtggctgctgatggtctgaaaaagcacatctccccatttggatcctccagagtttcttgactccctgtgtccctttgcatttccatagaaattttaaaatcggtgggtcaagttcactgagaggcagaaaaacatattgaggctttgattgtgatttaatcatatctgtaggtccatagatcatttaggcagagacttgacatcttttcaatattaatttttctaatttttcatgtagaagtttttcacatcttttgttagatttattcttagatacttttgttagatatattcccagaattttaaaatgctattttgatgagtcttagaaattgtgtgttgtttgttctggtgcataggaatgcagtatacagttttcgttttgttttttttcaatcgactgatttgtatccagcaaccttacagaatattttaatttgaatattcacatatttatttggatttctataaacacagtcatggtcttctgtaaataatgacagtccctcctaccccatctttatactttctctcttttttctatctgtgctacactgaccaggactagtgttgaataaatgtgggggcatccttaacttttttcttatcccaaaggggaacacatttaccctattaaatacgattttttgagctaatttcgtaggcaatctccatcagattaaggaaggtttctttcttgcttataagcgttatttctttaatgagtggttattgaattttagtaaatgcttttttgtgcatctatcaagatgatcatatgctttttctcctttaatttgttagcatggtaaagtaggcatgcaggtatgcgcacatgcgtgcacacagtgtctttaatggttgagctgtgtgttagcatggtgaaggaggcatgcaggtatgcacacatgcgtgcacacagtgtctttaatggttgggccgtgtgttagcatggtgaaggaagcacgcaggtatgcgcacatgcatgcacacagtgtctttaatggttgagccgtgtgttagcatggtgaagtaggcatgcaggtatgcgcacacacgtgcacacagtgtctttaatggttgagccgtgtgttagcatggtaaagtaggcatgcaggtatgcgcacatgcgtgcacacagtgtctttaatggttgagctgtgtgttagcatggtgaaggaggcatgcaggtatgcgcacatgcgtgcacacagtgtctttaatggttgggccgtgtgttagcatggtgaaggaggcatgcaggtatgcgcacatgcgtgcacacagtgtctttaatggttggggctgccttgcatttcaggtataatctgtctacactttttatgcatttctgggtttggtttaatatttttgtaactctttttttaaagtaagtgacctgtaattttttcctgtacagtttttgttgggttttaacaccaaggtcatgctattccaaaaatatgagtttgaggagtgtttttctattttttttctgcctctggcttttagcaagatttgtagaacttccagttactcatctgggtcttgagttttctctgtggaatgatttttttaaattatgatttgtttctaaaatgattatcatgtcttctatgcctttatgagtcagttttggtgagttgtgtttttctagtacttgtctttttctttgttacttaaaaagtttagtggcatagagttgttcaaagtcacctcttgtcaatgtggatagttctctcttttagaattctgtaccgtggttttgcctgcctgcctgcccagccccctcccctcccctcccttcccttcccctcccctctcctcccctctcctcccatctcctcccctctcctcccctctcctcccctctcctcccctctcctcccctctcctcccctctcctcccctctcctcccttcccttctgttcccttcccctcctctccttctttcttttctttctctccttcttttttttggagacagagttttgttctttctttccttcctttctttttttcttttttttttggagatggagtgttgctctgtcacccaggctgtagtgcagtggcgtgatctcggctcactgcaacctctgcaacctgggttcaagtgattctcctgcctcagcctcccgagtagctgggactacaggcgcacaccacaacacccagctcatttttgtaattttagtagagatggggtttcaccctgttgcccagggtggtctcgaactcctgagctcaggcaatccacctgccttagcctcccaaagtgctaggattacaggcttcagccaccgtgtccagcctttctttcttgattagtcttactagagcaggcatggggatgatagtgaaaatgttgctttttatgaataaagcacagaagtgtgtgcagtgcacaaacagaaacatcatatacctgcgatgtcaacatttcatgggagggggattagggaaaagattaggggaaagattgggcgataataaaatagaggttgagagtcactgcatgagaggctggttcttttcagggaaccagcttgtggctttgtggatcttctttgttatctgtttgctttcattctgtcagctttggatccttccttccttttactttctctgggtctgtcttcttgtgatggatgcttactcatcctcagctttctttcttctcttacatttgtattaatggctatacttttccctcccagtgcagctttgctttttcccactgggttttatttgtctctctcatttgaagtaggctggagcgagtgtggcctagttcagaaatagaaggctggtttggctgtagctgtgagtgaggaggagagcagtagattaggtaggagagagaggcctagactaaattgtgtctgggcttgcagacctgggtaaggaactaaatacaactcaggtgtgctagagatccgctgtgtggtttcatgcagggggtgttgtgatctgctttatatttaagagactagagtaagggatcgtaggggtaggagtggaagggagaagagtgctcagaggctgctctagtgcaggggcaagacgctggaggcttgccctgggtgtgatggcggtgggaggacaggttctggatttgtgtgcatctgggaagggaacaggatatgactgcccagttcagcaagctcgtttaggatacttttattgggcagctcattaactgttctctgtggcccagtggatctcagtaagctggagctttgtaattttcacttatctctatgattgtttagtgtcctaacagaatgggagatttatttgggtaaagagggcctagaaacatttaagtattcccgtgatgctggccataaatacagaaaatttggtgcagtatgtcttcacattcctacaaatttagtgtagttcagttctcaaaccatgctggtagtatcctgggggtcttcaggacccttttgggggtttgtgaggtcggttgctaggacaggcctgcgtttccctggcgcctggatctgcactgatggcgggcgcaatggcgggcagtgctgtcggagtcttagtggctcccagttgacccagtcgttgcatccatgatagcctcataactggccgcaaaaacacactacttgtgtcaaatctgggcccttctgcacgtgtttttaccccactgagtgcctttgcacagactgcgatctgctggttgctgagggacaggcactagtgggatccgggaggggcctgttggttttccccgtgggatgctgcttttccctgaaagaataagagacaggatgaagtgagcttgtcacttcaaggaaaacaactgatggcaattgttgccagtgataaaaattgagctttcaactgtaaattaaattagaattttaaaaaacctgtgtcttccacggtgaacttgtcaggttaccagcctgttctgaggcctgttctgatgagaccgcggcggccatgctgggtgtgtttgatgctgcagaagagctctgcacagctcggtgagcccatctttccacatgaccagtgcgtgctgttacaacaccatgtgtgggtaaagagccacttcaagcaccagctaggacagagggtctcaatgtaacagagtatgaaaaagctactgaaacagtttccttatccaacaaaccgcttgtggagttttggtgtgtatcaaacaatactgacaattatttcaaaagactacgtatacatgtgcagctccatatgtgatgctggattttcttcctgtgcttcagttgaatcaatgtattacagcagattaaatacaattgcaaaggtgagaatccagtgacttctattcctgagccagacagtaaagagatttgcaacaatgaaaaacattgccactcttttcactaaaattttttgtttgggaaaatagtttcatttttaataaaaatgtcattcatgttaacctgtaacaggctttttattgttaatttgaaatgaattaatacaaatgagaagaccctcatttcaatgtataacatggtaacatttggtagtgataattgggaaggggcgtctttggactcctccgtgattctaaagagtgtgaagggaccttgagactgaaaaatccgagaactaccggtttatagaagtggaagcatttagtgatattgccgttcgttcctttctttccttccttcctttctttttttctttcctctttctttctcttctcttctcttttctcttttcttttctttcattttgagacagagtctcgctctatcacccaggctgcagtgcagtggtgcgatctcggctcaccacaacctctgcctcctgggttcaagccattctcctgcctcagcctcccgagtagctgggattagaggtgcgtgccaccatgcccggctaatttttgtattttgagtagagatggggtttcaccatgttggccaggctggtcttgaattcctgacctcatgatccacccaccttggccgcccaaagtgctgggattacaggcgtgagccaccacgcccggccgtgcagttctttaaacgtaggaaatgacctttgagttttgagttcgataccagcgtttctactattaaaggtggactttctctgtcaatgttcttggaatcttatgctttccacgaagtccttgcacttgtgcagaactgtatccccttagccatgtgaactgcacggagcaacgctgttgcaggatttccttctgcctcactcagaacatatgtgctctgtgtgtgaagaagctcgtcaggctgtgagcacagcacaagaataaagcctttagaactcagcagagagaaccagccattactgaaaatggaatgttttaattaaaaatatccatcaccgggtggctcttcttttcctttatttctcaagtgtggcaaatgttaataacagtggctgcactgtggctccatggtaaattgccagttggtgagtaggatttctcccatgaagcttagagatgaacccctgcaacatctgttcttgtgacaacgaatcccttttttactttggcttatgcatatttcagaggttagagacaggaggctccttctaaaagtgttcagtaactgcctgggctgatgtgtgtgcctgagagtcagagagagagagggagaaagagaatgggggctaaggggaacaagaagggagagagagagagagagggagagagaatgggcactagggagaagagaaagagagagagagacggggaatgggtgggagcatatgaattcattggtaaccctttcactttcttttcttcctgtattaattgatgggttgaccttattaagtgggttgattttggggtttctactgcagtgtaacaatgagcatgcagatggattttctgattgtttacaaggaaatcaacctttacactagctccagcttttttcttaaacatctagttctattagaaaaaaagcaaaagcacagcagatagaagtcttgaagcctgcagtaaaacactgtggctttccattgtgaggacgtgcctgttctttattacacacaggctgcttctgtgatctgctgagttgggcagtgtcatcttagcagacagggtttttccccccccttagatggggtctcgctcattcgcccaggctagagtgcggtggcatgatcatggctcactgcagcctcaacctcctgggctcaggtgatcctcccacctcagccttctgagtagcagggaccacaggtgtgcaccaccaacatctggctagtttttaaaatatttgtagagaccagggctctctgtgttgcccaggctggtctcaaactcctgggctcaagcaatcctccaacttcggcctcccaaagtgttgggattttgggcatgagccatcgtgcccagtggcaggagggtttttatgtacatgtgcttgccctttgtcaggggggtggggtgtggctttggttttgatattttcactggtactgccaggctattttgattcttcttataggagtcttgaccgtcaaccacctgccatgctgtttgggatgcagtgttttgaggatatccctggggactttactaaatggacctatacaagttgataggccttgacaacttttctcttactgtagtttttgttttattaccatttaaaactaaaggctagggagatgagccgtcctagattgaacgtgcttattagcgtggatatgttgtgaagaaatgcacgttggaaaacatggtcctccagaagcaattaacttggcagctattttgtttacattttctatgattaatatttacattttattttaagaaaattggttttttgctgccttgatctcatgctcacattttcctggttgagattggaaccaataagtaaagaaaattgacctatcaacccttttaaatgttagaaacctaagtcagagagaactgtgttaaaagaactgtgtttatctttttggttaaacctgttgtaacactgtgtggttaaattttccctttgtgctctcttcccctaatcgttcaaaggatagtgggcactattaggttcgacttttttttttaaatgtttatcttagtggtgggtcctcttatgggctagtcatttgtgggcataggttggggtgtgcagggtttatggctaattataggatcatatgtagtggttctctgtgatcaggagaaggataccaaggtttctattttacttatttattaggttgtgtaacttttttcttttattcttttatgcttgatgatggtgttggtgtttaggaacccctgtttagaaagcattttggagaaaacctgatgcaattttaattttgatgatgtcaatatctcattagataaggccttgataaaataacacctttttctcttatttcaatggatccaaagagaggctagcttggaagtggagtggtggtgatcaggaagggactcaccaccacgccacagggttgtcacatattttcctcaaagcaaaatgtaatttcctcttaaaagaggatttagatcctggcattttagcagctgtttttaaggcctggagctttggtattcctggctgttttgggaggcagtgctggacagccgattcgttcagcaggtgttgattgtgtgctgacttttgtttggcagtatttggtctgacatgggagggagtttgcaagaagcttacagcatcatttcatatggttggaaccccaagtgtgggactagcacacctaaaacagggacgcacagaaagggaaggcagctgtgattaaaccttgaagctcgtagtaccaagctcaagcctcggcatttggcagtaggagaggtgcagaatggttgggagagcctcgtagaggggatggaacttgagctgggacttgaagaaggctgagagaagggacagggaatgcggagtttagggagggtgttcacagagattttgagaggaaaccgagcatggctttttcatggaactgtgtgagtgtctgcatggcttgggtggggatgactaacttgactcaaattactcatccctgggccagactgcggtagcctggggaccaggtgaaggaatctcaaccttatattgtaaaggcaatggggagcagtgaaagttttaaataggtgaaagataggctttgttttctcttttctttttcttatcctttttgtttgtttttgagacagggtcttaccctgttgcccaggctggagtgcagtgcgatctcggctcactgcaacctctggctcctggctcctcagctacctaggtagctggaactacaggcatgtaccttcacacccagctaattttttgtttattttttgtagagacaaggtctcactatgttgcccaagctggtctcgaactcctgagtttaagccatctgcctgccttggcctcccagagtgttgagattacaggtgtgagatgctgtgcctggccatgttttttttgtttttggttttttttttcctaaagattcatctgactgtatgtggtgtttcacacctgcaatcccagcactttgggaggctgagaccagttgatcccttgagcccagcagttcaagaccagcctgggccacatagtgaaatgccatctctacaaaaaaattaaaaatattagctgggtgtggtggtgcacacctgtagtcccagctacttaggaggctgaggtgggaggatctcttgagtccatcaggctgaggccaccgtgagccgtgatcatgccactgcactctagcctgggcatcggagtgaaaccctgtctcaaaaaaaaagattcgtctgcttgagatgtggggcgtgtggaaggaagtagaccagtggatacggtcacccaaagcatgatgggaattccagatactatatgatgccatttcaacatggaggagtagaaatggtgatgaaggtaaagagaccacagcagagaggcgtctagaaagaaattaatggctctgacaacttatttaatagaagtggtggggtgtggggcagcccaagataacaaatgtaattttcagggcaattcatggatggaggaagaatcaattcagatttctgggttgtactgtttttgatattgtattctaagatggtcattgcttcttattaggagacaaaaaggtttttaaaaatgtgaaggtcatctgcagttttttggggtgagagagtcctcaggaacgttcgcatttgcagatgcccaagagccttgagtccaagttgctgatcttttgcgcagggtggttctgccgcagtctgcgaggcttctggagggcctcgtgagcttgcagctctgtgatcctgctgacaaactggtttctttccacatgtggaatctgtgttttccctgcatggagcagtgaatggggatgtgaaaggcaccggacatgaagctgataccgtcacagtagaatccagaagagctgctcagtaaaacagcttatacattaactgttcagacgctagaaaaggcttgtattgcttattgaccttaaactttcttgattctttctatctatctatctatctatctatctatctatctatctatctatctttttgagactgggtcttgctctgttgcccaggctgaaatgcagtgttgtgatcactgcagcctcaacctcctgagctcatgcagtcctcccaccccagccccccgggaagctggcagatggtgttgtcctcacatggccacaggcaagctcttcttataatgtgaccttgacacttctgccattgtgagtagggtccctgttccctcccgttgaatctgggctgactcgggactgtagaccaggttataaaaggctctcccctggatctgctggggcgtgtgctgtgaggaaaccccgcagccatgcggtgaggccctgtgaaggtgagccaccatgcagtgattccagcccccagaagacactcacccccagacttaagtcttcccagctgaggccccctgagacctgtggcgccctttcctaattcttgaccatgggacctgtgagcataatgaaatgattgttttgtgctgctaagtaaagggaggtttgttaagcagcagtggataacttgaacatgttttggaagctggagccaggtgtggccataatcaaatcccaatgcctgcagctctggctttgggatggggtgttgggcagaagcctccgggcctccaggagagtgctgctggctgcctgaagggcctcctagaaggtaatagggtctagtattttagcctgtgggtggcacatgatgactgtccctgctactctgccaatgtgagaaggcactgcagacggtgtccaccacatgggtgccctggatttggtcctcagcaggctgggcttggcctactggctgccttttgcctaccccggaaggaaaggagggaacgtgtcattgcacgctggaggaaaggggccccttgttaggtggtggtgggaagcctggtgtcattgttgctgtgggaaagaggaaagtatgtgtgtatttaatgaacttgctcatctagtttaggagatttccaggcagaaaattcaaagtgccacctggcttctccttggtgtaaaggaagaggacttcctgggttcaaaaataagactgtttctcattcccagcctcttctccaggctcctcaagtgaagaaagggcttccggcaaaatgcatctggactgggctgtgagctccgttcctaaggcttcagattgagatccaagtgcagtgtctggcctttcagctggaggagaggcctgcagattcttgcattaaatcccgtctggcctctaagagtccaaagggcgttgtcatgccacagcctcttctgggagcccaggaggtaaagggcttgtctctttatgggtgtggcttgtctaatggaggagattatgagttaatacacaaaaaggccaccaagtgtttttaaagaaattatgtgtctgcctggactgaaaggagcagaggcaatacaaaatgaaaataagtctttgggcccccagacttctgtgaggaggaagcaggctgtgaaaatcacccagctgtaaatgtggggtacttttcatggaaaatgaagtatatctgagaaggcggagctgagatcccagaaaacaagccccaggtaccaggacagagccctgatggaggtgctggcgctgtgtgcctgcctcgagtggctgtcctgggtgggacattgtgtgtggggtgtgggtgtgtctgggtcagctctttagacctggattgggaagaacggggatggaagaggggtggacttgaggaactgcatgttcctgcacacaggcttctcagctgggcagggtttaggtgacgagaccccagacttcaagctgatagcagtaatcggacaggccttgggggccctggggaggtgtcaggttcattttgcatgtgggaggatgtgacgtgtggtggccagaggatggacagtggcagatcgtattttccagagatgaccgcagcagcatctcccgccgcacgtgccctctctgcagtgtaactgtgaaacgcctcccaagatgaccgcagcagcgtctcccgccgcacgtgccctctctgcagtgtaactgtgaaacgcctcccattgagaggcgaagttgctgttctttcccttggatctggatgggctgtgactggatgggaaatggcgctcttggctggtgtgctgaggacgacataccgttcacctggttctctcagaacccaagaccagccccatcggagaggctgccagaggaggccatgggaggaggtggtttctcattaacagcgaccaccactgtcagccgccagatgtgtgagtggtgaagcttctggtggtgccagtgccagccactgagccatcaccggcctttgcatcttgcctgctgaggacccggacattgtggagcagagacagggtgtcccctcccttcccttcctgaattcctgcccctgcaggaaggagaaaatgattgctggccatcactgagggttggggacctggctgtgcagccgcagcgccggcgggccgctctcccacatctcaggggcacgcaggttccgtgccagggatggctggtcaggccccgcagatgggcagaacttctcatcccacacatcccagccttctttaaacttccctggcagattattttatggttttgctgctgttggtgaagatggttcagtctttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccggacagaggggctcctcacttcccagtaggggcggccgggcagaggcgcccctcacctcctgggcagggcggctggccgggcggggggctgacccccccacctccctcccggacggggcggctggccggtcggggggctgaccccccacctccctcccggacggggcggctggccaggcagaggggctcctcacttcccagtaggggcggccgggcagaggcgcccctcacctcccggacggggcggctggctgggcaggggggctgacccccccacctccctcccggacggggcggctggccgggcggggggctgacccccccacctccctcgcggacggggcggctggccgggcagaggggctggttcagttttcttttctttttttttggtgggggggagttttataactttatttgatgtatttgatgatcagcgattagttctcatccacattgactgtctgtagatttttgaacatggtaacaggtacataggtaaccaaagtatagaacttatttggtgaatcttcatcctcattacattttctggataaccacgcacggatgcggtaggggacattccttattcctttggcccagacagctttgttgagcctggtgtcaatgcacacatctggagttgccatctccttcatgtcaaatttccgaatctctctgagtgcccaaggggcacgcttcatgaagcccactccgtggacgcgctggtgaatgttgatggtgtcttctcgggtcaccacctcgctgattgcagaatggccgtttttcttctcgccatccttttctgcgggagccattctgccgggtccaagttggaaaggaaaaggacagttgagttttcttgggttgtccattggatgatcatcccagatgggttctttgtacttctcgtgttcacatggtttagggatgtttttctgatgagtggtggaaagtaggaactattcatggtggctggatttggcgcctgtctccctcatcatgctgtttatttttgtcatgaaaaacatctttatcaataagattaatctcacttttacccagacaatgtaacctgtagacttcgttgagtaaaattggaaataattttaaatctaatttatcttgttgtcaaaccaagagaaacctatcaagaaaccgctaaagcagtgagagctcagaatgaggaggtcgtggcataaaaggtgatttttctgggagcttcacatctaggcgatggtctaatttgtactaagtgcgaacacgcattgaattcagggaactgggaaagcacgcgtgtttgaccctgcgcgctttgcaagaagctcgtgggggttggtgcatcctttgaagggttaagggaacgaggggtgaaaagttgattattgtttggttgtgcaaatgtggtgctgggtggagtccccaagaccacttcctgcttccaggatttactgggagtactcacaggactcaggatctaatactcatgggcatgatttattacagtagaaagataacgaagcaaaaccagctaggcgaaagggtgcatggggtgaggtctgaagggaaccaggcacaagtttctgaaagccccgcccccatggaggctcacaggaggggctaatttcccccagaacaaggtagaccaatacaaggtagtgaaatgttgccagccaaagaagcgcatccgagacttagcccccagggtttttactggaggctggtgacaggtagcctttgccaaaatcccagccttctggcaggaaagcaggcattcagcataaaccatattgttggaaaacagttgaggcacagcgaaccccacttactagttagggtggtgggaatcctccagaaatccaagtccgcagaccccagccacgggccacccctgtaagcagggctttgaaaggagggctgctggggcctgctttcttaaccctcttctgcacagataccaacttatcctttcctttctgattaatgtctctcaaacacagacgggggaataaaaacctgaaaacaagcgaatattgacatgtacatcaccactttcaatcagctattttcaaccaagtgctgaagtataatacagttgtagtcacaaaggggaagtagcaggtatgttgcaagaaaaaacttattagaattgtatgttaacttggatagaaacagaacttttctgagcttatgtgctgtgcagatacagaatgctggcagagttacttctgtgagaacatcattgaattacaattaaatattaagtacctataaaatatctttgcattacaaaagtggttaaagtaactttctcagtcttcataaatgtagatagtatctttggacaaaataatgagttagtcttttgatggaacaggagaagcaggagaaaattgttccaggagcagggttgctgacgatgctgtccctgttggtccagaaggtaaaatcctcctgtattagtctgttctcacgccgctaataaagacataccagagacagggtaatttataaaggaaagaggtttaatggaatcacagttcctcatggctggggaggcctcacaatcatggcagaaggtgaatgaggagcaaagtcgcgtctcacatggtggcaggcaagagagcttgtgtaggggaactcccctttataaaaacatcagatcttgtgagacttattcaccatcatgagaacagcacaggaaagatccatccgcgcgattcaattacctcccaccaggcccctcccacgacacgtggaaattatgggagctacaattcaagatgagaacacagagccaagtcatatctttttttttttccccttttttttttgagagggtgggtcttattatgttgcccagctggtctttagctcctgggctcatgtgatcctcttgcctcgtcctcccaaagtgctgggattataggtgggagccaccacacctggctgattttctcttatgggttggagtaaggtatggccaagacggttaagacgatccatgtcctgtgggatggcccatgtttcaccagcactcagatgccctggggctcggggcttatgggcagttttgctaattctcaaagttaagttttcagctgggtgaagaaggaagaaaggctgtttcgttgaactcagtgttgaggagagcagtgactgacagcagtggatgtgctctcatcctcctgcttttactgggagaggggctttgtgatggcaggtgtataacctctcaggttttatttcttttacattaagaaaaaagaaggtggggaggtggtgggtgacagagcaggtgatacgtgagagtcagtgaaaatgcactgctgggagctagagagcctgcgcagggtttttccgttactgtgtccgtgatgagttgaggaaaccgtgtctcagttctggaccatggccgagaggaagtgcatagtcttaagtctcttatctagtgatcatcaacacaaatggggcataccggctgcaaaacagagttgggtaccagtgaggcctagaccacctgggcgtttctcttccagagctacagttcctaggtgtaaaatagagctggtgatatacaccttgccaggttatttgaaaatgcaaagcacccagcacagtgcctgacacatgggaggcagtcacagacccatctgtgctcagttgctcatgacgaatgcccgttatgtctcaggcacggactagctgtgcagtaagagggagctctgagtcagacggagggtggatttgctctttgggcactggtgtagctctggatctgattgtccttcattatctaggttttggaaatgtgagtcattatgtaaagcttgaggtgttggtaggtgctaggtgaatcaagtgtggtggtggtgttttctatgcgtgtctcttaccaatagacttttgtttttgttttttgagatggcgtctcgctctgtcgcccaggctggagtgcagtggtgcgatctgggctcactgcaagttccgcctcccgggttcacgccgttctcctgcctcagcctcccaagtagctgggactacaggaacccaccaccatgtccggctaatttttgtattttcagtagagacggggtttcaccatgttagccagggtggtctcgatctgctgacctcgtgatccacccgcctcggcctcccaaagtgctgggattacaggcatgagccacggtgcctggcctttttttttttttttttttgagacagggctttctgagactccaggagtggtctatcatgccctgctaatttttttattttttgtttcttttagagatgagtgttatgttgcccaggctggtctggaactcctggtaccagtaaactttttaggaggtttccgttagcttttgaaaattttttacctgatctttaaaaatgaatgcagttgtgtagcaatttttaaagtgattgacagttttttcccaccctaccttttcttgattgaagcagttgattaaggattttgggagtggtcctattgtttcttgtatttttctgatttttgttttagtgatgacactgtgggaaatcatttgtcaggggcaaatttcaatcttctgtctgaatggatctgtctacttatctgtccatttatttgttcactactgtttacctgtctgtccaaccacctacctacccttccgtctggccatccatccatccatccatccatccattaaagttctttttgggggtgtgagtatccgtttaattgcactgcatatctacctacaagtcatacctcttagcaatcagcaggcaatgaatcgggccattccctggttgaaattcaacttgagatttctagagggagctactcaggttaaggatgcattatctaacaagaaaaatgaatctacagtaggtcgtattacagatgcagcacatgaaggcgcccacacattacttcttagcagctgagtgtgaggtgcatgcatgtgaggctcagaccccacggtcttagggcatccttcaacttttttttttgaagaggagtctcactctgtctcccagactggtcttgaacgccccccttgcctcaagtgatcttcctgtgtcagcctcctaaagtgctgggattataggcgtgagccaccgcgcccagctttcttcaacctgaaaactatttaaacattttattactctgtagctgttggcagtaccagattttatttacaactgaaggtagttttggatctaaaaccacagttttggtaatgttcaaaaaatggatcatttagtggttttaatgtcatgtatcaatcgttttcagagtatcttttatattgctcttctgtatatgttagcttactagttgattagtgtttctgtaacctgtcctgctttctaatctagccactaagtggttggatcaggatttatactcagctatgcctcctttaaaactgatgttttgtccctcatctccctaaagtttttaatggcatatatgtgtatatatgccatttatatatatatatatatataattatttttaagttcattttgcttttatatctccccgattttttgacattgtttgtttagagaaatttggccacagtttttagcactgggtgctgcaggatgagggctggacctgctgcttggagctgcagtcctcatcaggtacctgctcgttgtaccacctgcaccaccacccacatgctccccaattttttaaagttaattaaaccccgtactgaaggtaaaaatatgtatacataatttttattataatgctacttaaacatataaaacccaaggctaggcataaattccttatggttagaggaattttgtgcagctgtaaatcccaaacatacaaattcagtccaactacaaaggcagtaaatgaacacaattaatttaatgtgacaaaaggatgtagttttgctgacggtgtattgctaatgttgggtttcatgatacagtgtatttgtatttaagatttttgcttgctgtcacttaattcttttgattttgagagtgatagactctctcatttttcagtttactgagcagggttcccccactcctgccacctgcccctgcccgacggcgcagcacagtgacagcgacttttcttgtgtccatctcccactttgttcaaatggcagcaaataggaatttatgatctcatttccctcctttccttaggagaaaagtaatattctatatgcattattctgcaattttcttttttcatataacagaatattctcgaggtcttccctatgagtgcatggaaaactttgtgggccatcattggagttgccgtctttacagccgttgttttttctaacaatgtatactctaatctcattagaggtttgtcaccgataatccagattacgtcttctttggccctcaaacaaccctctgaagtaggtggcggtgggggtatcaggaagagaagaaactgagattcagagaggttaacggacgtgactgaggcgacagatggaagtgtgtggggacgtggcccaccctaggtctgtgtgcctagacaaaggctgggtgcattgctgccttctcagggccactgccgcctgctgagtccagcatgttcggggcactttccccccttcttggtgatggtgcgctgaggcccacccgcagtagctgaccgtgttggtcttgaccgtgttggtcttcagagtcctttggtgtttattgagtgcccttgggcagatgcgggaacaggtgcttctgcgcgtggttcagatggaaccgctatagtctgcagataactgagcacgaagctgagggtggtcagacgcctattagtcgcaaaatttgctgacccaatgtgagagtcgggaatgaacaatgccttttactgacctaggaggtgttacaatgacaagaagaagtcagagtgggcaggaggcactaggccaggagaggagagagttgggaggaggaagtggccatgctgcaggtgccctaacagatccagggaagcatggagagcacagcgcgacccgtgtggagagggcatcactagcctgcctcgggctgcagggggcggggagcacatgcggcgtgcagacctttccttaggtttgtgctgggtgctctgctctcaggcccacagaattctgcactgtgagcagcgcaggtcggaagaggcatttggaaatgacacgctctgtccaggaactgcagtaaacgttctagctgttaatattcttccttctggcagatggtgggtttcacactgagttaagtagcttcacgactgctagtggctggaagcttccagattagtagtttaagccagaaaacaatgttgatacgtcttgagatgtgtataaatcatttgatttggctgggcagggtggctcacacctgtaatcccagcattttgggaggctgaggtgggcagattatttgaagtcatagttcgagaccagcctggccaacatggtgaaaccccatctctactaaaaatagaaaaattagccgggcatgatggcgcacgcctgtaattccggctactcaggaggctgaggcatgagaatcgcttgaacccaggaggtggaggttgcagtgagctgagattgcactgctgcactccagcctgggcgacagagcgagattctgtctcaaaaaaaaaaaaaagtttaaggtgttggttgtgtgtgtgtgtgtgtgtgtgtgtgtgtgtgtgttaagagagccattgtaggctacatgcatgtggtaatagactttaaagggtaaatggaaaatggtagcttacaactgacatttagccaattgaaaagtgtaggccagggtgtagatagcacattcccctgcagtgcctgctgggtcctggaacgaggccttccagcaagtcggttctcacgtcaagggcatgtcctgagggttatggggccttggccatcagggagagaataaggttttctcattttcgacttcaactaatggtcatagagttgcttttcttttcatttattggtttactgtcctttcctcatcctcctctatctctgcgtcctcctttatctccagctcttctcctcctcctctttctcttcctccttctccttctccttccctccttgcatttgttcatctttaccacattcattatacacccagcaaaatgtgaaacctttcatttcctgttcctggtacatgcagcaaaagcttgattatacaacattatgatgatatagacagaaaacacgtctgaattgtgttcatggaatatgtagcattcccatggttgtcaattactgtagctcattacggtgagcaagtatgtcttgttagtaagaaggttcagggagttgagatgacggggctgagatgctgcctgctgtctccatggtatgggcaggtaatggtgcagggggcgtttatgaactggtgtggaggtgcctaatagggaccctgtgcttgaggaaagggcagaaggctgatggcctcgtggctgtactcccgggtgcttcttgctgggcggctctcactgagtgggagtgaatgggaagggaaacttcctgatgtgatccttcagctgaacctagggatgatctccacgacagtagaccctgaggagcaccccgtgccacccaccaggagaagcccagaggaagtgataccctccctgacttgttagagtgcttctcttgaaggaaagaaaacccagaaagttctttttgacttctgtcgtactgaaggtatcatcatcttagacaccaatttagcatgaagggaagataatgtgtcagacacttgaatattgttgcacgtctgcttttccaactgaattttcgagtgcagatatatgtgcagtctgtttaatataatgggttttcgatcttgtcctttcttggaaagtaaaatgctttttattacctggaaactaatttcaagcaatagattgcatttttcctgggagtcttgtggtcagttttgtttttccaatgcagattgcctccaaatctttattttgaaaacttttcacacaattggaagacctgaaagaatggtaccatgaacacctcacactcaccactttgacacaaggcttgtttgcattttgtcgtatttgctctttctgtcacacttttgtttgtttttgaatcatttgaaagtaagtagcacatgttattattattattattattatttgagatggagtcgcactttgttgcccacgctagagtgccgtgatgcgatctttgctcaccgaaacctctgcttcctgagttcaagtgattctcctgcctcagcctcctgagtagctgggattataggcacgcaccaccacacccaactaattttttatttgtacttctagtagagagggggtttcaccatgttggccaggctggtcttgaactcctgacctaaagtgatttgcccaactcggcttcccaaagtgttggggttacaggcgtgagcaggagtgagccaccatgcctggctagtgattttcttcctgaatactcctgcacacatctcataagaattcaaacatcattcacccgtctaaccataataccaatatcactcctaagaaaattgaccatacttccacaatattatctaaatagttcgtctatattgaaatttcttcagctgtttcaataacatcttttatagctgtttttttttttttaaaaaaaacaaaatctactcattatgtttgtttctttagtcttttctaaatgcagaggtttttccccccctgtaaatgacacagacttcttgtggaagggtcctgctgcttgtgttggagaatgtcccacttaggttttgctgagtgtttcctcatggcatcatttcacttgtcttttcattccctgcatttcctgcaaactggaagttcaatctagaggtttgattgtatccacattaagtctttttggcaagaacgcttcataagtgttgttgatgacttcacattgcattacaccaggaagtgatcagtctttaacttagaagatttgctctcactctaaaataggatagttttaaaaataggcatcttttttaagggaagtgttctcactctttcacccaggctagagtacaatggtatcatcatagctcactgtaacctctaactcttgggctcgagtgatcttcacaccttaccctcccacgtagctgggactacaggtgtgcaccactatgcctggctaattaaaaaatttttttgtagagacagggtcttgctgtgttgcccaggctggtcttgaacttttgagctcaacagatcctcccacctagacctcccaaagtgctaggattgcaggtgtgagccactgttgggcctaatatatgaatcttaatgtttactctgtcttcacacataactgattgtctagttattaaattctgtgttgtaaatctgacttgcttagcttccagtgtcgaattatctgaagccattctgattttcagcctttgctttgtggctcatttgttctctgaagcctgtgtcttatgtacaaagaaaggtgtaaatactcttcttcgacttttaattgaaactgatttggaaatcatttgtcacaacctgggcaacatagcgagatcttgtctctacaaaaaatacaaaaaaactagcttggtgtggtggcacccacttgtggtcctagctacttgggaggctgaggtgggggcatcacctgagcccaggaggttgaggctgcagtgaaccgtgatcacgccactgcactccagcctgggaggcagaatgagactttgtctcaaaaacaaacaaacaaaacttttgtcaaagatgtaaggccataatgtggatggaaattttaaggggaaagtaaaatatataagcgtgtatgtatagttataaaaagaacctaaagcatctcaaagtccatagtccgtcagcatcagcgtctgtccacagagccagggtccccccttggatgcatctcctgtaagatgaaggcccccctgccctggtgtgatgtgtggccttcagtgatcatcatcatcctgtccgagagtcctgctggctctgcttggagaacctggccactttcctgcctctgctcctggcagcctccgtggcccgtcacttcttgtttgcctgtgaattctctctccagactcgagtgacactttgccttgcaaagctttccccagtgctgtcagacagggttagttctaagtctttcctgggagatctgtggcactctgggcatttctggaaggaaacttatgtgtgtctcttgtccctggaagggacagggcacatcttgttcatcagggcaccgcagccccaggacctgactctgatgccacaagcatttaatgaagacgttcaaagtgaacattcagaatctctgtctcttcatacttcttttcttgtgcttatatttagtatgtagtaacattcatatatggacactttcaagaactaacaggacacaggtgctgtctatggttgaatgacgctgtgttggactcgggctgggctgtgtgttgtgtggacacaggtgctctctatggttgaatgaagtggtgttggactcgggctgggccgcgtgttgtgtggacacaggtgctctctgttgttgaatgaagtggtgttggactcgggctgggccgcgtgttgtgtggacacaggtgctctctatggttgaatgaagtggtgttggactcgggctgggccacgtgttgtgtggacacaggtgctctctgttgttgaatgaagcggtgttgagactcgggctgggccgcgtgttctggataagtggctgtggagcacgatgaagcgtctatcgcagcatcatctctgcacccagatgtggccgtgctgagtggattcctgccccagatcttgggaagaaggttggctttcctcctggtgttggtggaaggcctccccggcgacactgctgcactccactggggcctttcattgtcctgtcccttcctgacaaggaaatggctggacactctcttcatgtcagcacccctaggtgctgggggctcaaagataagccaggcctggaagacccacccagagccaggggagcccacccccaatacacatactcaccaagccacatgctgcggttgggggtcccagaggtgtgctcaggccagcctgtggggacagcaaagtggcctccccgagaagggggcctgtcctcagtgtttcagaggcctcaccttgtctcatgcttgaaatatttcctgaagaatgccatttttgaaatttattttctaaagaaaaaaaatccaaatattgaaaggctctgcttgaatttttgtcaacaattactatatcaagaaaatatttctgatttaggtggctccttcagaatatctgattcctgtgttggcttctgcgttgcctttgcaggcctgtgtctgtaggtgaggttttcctgttcagatggagctctgtggtggtaaatgtggccttccttgttttatgttacgtgtttctctcaacttcatgagatcagaccagatagagaatgttaaagaaaaaatatttcgggcaattagaattgcaagaatgtcaagaagaaatatgtgtagtgaatagcaggctgtagaaaccatctcactgctcagatcttaaaatctgtagccaagagaggctttgaagcacccagggaagatgcatgtgccactctgcattttgtaaaattctgaaccatggactttattgtagtgctcgctttgccgacagctgctttagtcgtcgataatccccaaggatacttgcgtgtgctgttgccttcgtcaccaggacttggaggaaactgcagtgttgctatttgttatttcacgttgatatttccttccacctttggccttgtcctgcggtaattcctcatttaggattcctttgaatagttgggtcatggggagagttctgacgttattttactaaggtgaggtttgctaagccatcattcttacgtagatggcagaaaaagccattcggagaaaatatctgagtctgttcccgccaggttaaatagaaaggggatttgccaaggatctccagaagacccgagagccggtccctgacgttatggtaggcttcaagggggcttctgtagctgctgagcaactgagacagtggaggagtcctagaagacctgccaccgcctcctgaagagccaggtgcctctgccacacagctcacagggtgctcacctccctgtggaacgggggcctcgagtctcagggtctagaattggatcttgtaggtgcatctgatcataggaacccaggtcacatgctggccccttagctgcaggagtcaggacacagtctttttttccccaccttagtaagctatgaaccgtagcataagaaattgtcaaatatatggaaggtgttaagaagattatggggaactacagatggcagatgtctgccgtggttccccatggggcatcttaatggacggcttattactaggttttcagctgtgcaagacctttgattcacccatgcctttcatctctgatacccacttagcagcacatgctgttacctattctctttgaaattgagatttctttcttccttgtcccattccactcttgccacacctagctcaggccttcttattccaccgtgacagcttcctggctaatttcccttcctccattctttttcttcccaagtaaatgttagcccttgtcattaatgttagacgtcatcttcctgaaaatatccatttagccaggtttatgccgtggcagctgcagtggggcccggaggcctttcttccaggcctctgttattggaatccacctcccgcgtctatttggagctatggggcctttggaacggcttcatgagatgcgttggcccaagcagaaggctggtacagaagcagaacaaagctctgagcattctgagagttttctgttgagaaatgccatgggcttatgtcttcagcctgcctgggagccctgcatatttttacttgccttggggttgatttgatgaagcctgtaccatgggtaacatattgctggataatgaagagtggaaggaaaattagccctgaatgaatgactcagtcccatgataatgtggctaattttaatttgcatcaggaatagtaaagctgtggcccagtgtgttatcaaataaatctctaaacagccttgaaatcaatccatttattgaaaattgaaaatctttttttttttttttttttttgagacggagtctcactctgttgcccaggctggagtgcagtggcacgatctcagcccactgcaacctctgcctcccaggttcaagcaattctgcctcagtctcccgagtagctgggattatgggtgcacaccaccacgcctggctaatttttgtgtttttagtagagatggggtttcaccatattcgccaggctggtctcgaactcctgacctcgtgatctgcctgcttcggcctcccgacgtgcagggattataggcatgagccaccgcacccggcctgaaagttgaaaatcttgttccatgaaataaattttagaaaattagccagacatggtggcgcatgcctgtagtctgagctactcgggaggttgagatgggaggatccgtttgagccctattgaagcaataggcttcactttgtatcttgaactgggaaggagtggagaaaaaaaaaatattagagccctttgctatacttactttacgaagaccaattatttgttggtttttaaggaccagagttcccaggagtaagtgaaacacgactcgatctcttaagtgtgcccaatactgccagcacaacattcctcacaccggtccagcttgctagttaccttggatactcgcccaagcttcagctgactgcgcaggttattttctatatcttcagggtataaaaacagttgtatagacatacatgcacaaccatgaaaaaaatttttgactattgtggtaaagtcatttttatccccacttctgcccccccatgcttatagaaataacatgtttatggtagatggaaagtgcatacacagaagggccaggtacaaagaagaaaagaagaatcatccacgttcctctgaagaggtcagaatcactcatgacatcttgtgttttcatttggtacgaccttatatttggaatcacagttgtgggtacagttttgtaccctcctcttttcagttatgtttgagcatgtcctgtgccatttaatattctttgagaacatattttttaaacagctctactgagatacaattcacataccccagagttcacccatttaccaacagagttcaccaacagttgcaatctgaaagtatgtttttgtaaaggacatatactattttatcatgtaacactgtttaatatacgccatttaattatgcccttcaacgtggaattttaggcttccataggatacagtttatcgtatttagattttatgctgttgaatgacttggaattaatttgtaagtgtagagaaaaatgaatcctagggctcagagcactgcagcagatcacgtatttttgctctgtgacaaagtatttttattttcactttttctttttttgttaatttcaccccataaggtgtttcgggtagaggcaaatcccacaagtatccttggggattatcgacgactaaagaacagcaaagaaatggttcctagctcctcacgcagtccttggtgggcggtgggctgactggctgcgcacgctaggcctcaaggtagaagcggttcatttagagacccccaggcatagtcgcatggcttcacacacccgcaccagggctgaccatttgtttttggaggaaccacaaaaggattcagtatggaattccttaagaagggagtttctttagtttgcttaaaatagttacaactttttttttttaagacggggtcttgctctgtcacccagggtggagtgcagtggtgtgatctcggctcactgtaacctccgcctcccgggttcaagcagttctcccacctcagcctcccgagtagctgggaccataagtgcgtgccaccacagccggctaatttatttatttttatattttgtagagacagggtttcaccacgttggccagagtgatctcaaactcctgacctcaggtgatccgccaggcttggcctcccaaagtgctgggatgacaggcgtgagccaccatgcctggccaaaacagttgcagtttctataataaactttttttcccccagaataaaactagcacctttaaagtgagctataacgattccttttatgaaacttattttgtatgcagttcttattttgactttcagaaatctaaatttctcaagggtctgtgatgttggaactaaactcataccaagtcccttgtgcagtttgcgtggtgcaggaaggggtgagccaagtgaggactgtagcactcacgtgtgcgaaggtcgccgtgggcgaggcctcctcatccctgaggccgaaattttcctcttctcgtttccttttgatcaggatgttctacaggggtggaggcagattttaaaagcagtgatacatagacagaatttggcctaaaaaaagagtagtacttaaatctaaatgaggcctctggctcaaggtaacgagctgagctcatagattcaagcacctctcccctcattcccaattcccattgaaatgaacaaaggaatataaaaatagagagtctcccaagctaacacagttgctgctggtgatgatgatcttgttttggactgcaggttttggttgcagaaattcagttggatgtgcttcctgcgggtttggtgctcactttgtagcagtgcttggggatggaagtgaggggcaaactggcttttccttctcttggacaacttggttacccgcctccccttccctgcgaggtatatctactctctttgctatgtgttctagtttctgactctctttataaattatgcatttgtgtagcttcggctttgctccgagtttctgcttgatgctgtgaatcctaatgagcgctcccgggaattgggtggctctgccttcagacaaaccaggggatagtgaatgttgtgacctgtgtggccagccccagtcttgctttgtgtttattttccacaactctcagttgttgatgttgggaggataagtgtgagccacactctcagtgtgggggacagaaggcagtgattgggctgctgaacatgtttaatttcttcattctgcatggtgacttaggtgtcactgcacgtcagcctgtgaatttatacccaagcttgtttgtgccacctgatcacctgtatctttttaaatatatatgattttatccaatcagttatgaaggaagactctagtaaggaaatcccttgtgatttgctttgaattctttgggaggtgacaggcgttaataggtttttcacctgtgaggtgacatgctctgagcttacaggccttcgagtggaggtgatctggtctgcaggccctgtgtgcaattctgaaacccagaagctctgaacgctggattatttccacagctcatttggtggcaacgcttggcctgagctggggtgagactggacactcttgattgattccatggagagtggaaatgttaacgtggtgagtgttgggtgctgctccaaaccctcctgggtgtgttaaccctcctgggtgtgttatgtgagatggggcagagggatcacattatcctttcaccaagctgaacactgtggaatttcaaaaccaagctggcaccaaaggagcatcaagaacactgcccaggctgttataataacatcaggaccccactgcttgacggcccccagcctctcccacctggaatccaaagtgccgtggagatctttgagccggggcacaggatccttaggcgtgtgctccagcctttagtgggtgcctccaggatggctgggaagaccagtcatgagtcagaacttcagaatctgaaaaatccttagcacctgagaggtcatctgtctccaccccctcactttaaggatgaggaaactgttcaggagggattgaaatttaccgtcatgtccaaggccatgcattgttagtgagcatttatagttttatagtttctcaaaatgatactcttttcaaattcaaaattaacctatggggatataacgatgtcatcttaaattacattgcattggaggaaaatgtcttaaagtcaaaaaacttatgtaatattatgcagtttttggcacattaaatttgatagcccttacattttaaacattctgtaactgttattaaaaaacattaatcaagagtttttgaaacgaggttgccatagaaatgaaaatacaatgccaaaaagacattttaggtatagctaagaatttaaaaacttactaaatttgaggccaggtgtggtggctcacacctataatcccagcactttgggaggcggatgctgccagatcacccgaggtcaggagttcaagaccagcctggccaacatggcgaaaccccatctctactaaaaatacaaaaagttagctgggcatgctggtaggcgcctgtaatcccagctacttgggaggctgaggcaggagaatcgctagaacccaggaggtggaggttgcggtgagccgagatcgtgccactgcacgtgatcgtggtcaacagagcaagagtctgtttcaaaaaacaaaacaaaaaacttaccaaatttgaaattaggctcacagtgttaaaatctgcagaggagcaagacgtattttttttggcttaaggatatgtgatagtactgtcttttgcccagttttggagttaaattggtagctagatattagagctaacacgttgttctagttcatgtgtgagtgtattcgcgaggtgcttttcttgttttctttaaaagtataatgcaggatgtagggttaggtgtgtattgtataaacaagatgaatgaaattaatttatttcttgtcttcattcttgtctttgtatagtgtagctactttcacacattccagctgagggccatgccttcctattgctggcctgtaaagaagtcagaaatggtctctctaggtagcatttggtgagtcaggaagaccacacttgctgacaggcacagtgaggtgaggcccctagccatcccatgggactaaaggatgattcttgggcttctattaatacttttgtgtaagggactcagagatcttcagagatacttttataattaactagagctactcatttgactgagaatgttaaattttaaaaatttaattagctgcatttgtagaggtggagggaatatgacttgtctaaaatgacagccgaggtagcagaaataggaatcagtcagaggtgttgggaatgccgtatcaccgccctgtgtcggcctctgccgcctccccagccccgagacgcagaggaggaagcagacccagcagccgcagagcctcttcacccagcgagcttgccctagtcctggctgccccacttgctcgctccctggacttgcagccgccccttactccctggattcctcgctgggaggggaacgccaccacctagttcatgtccctgtggtgaaggatgaagtggactgtgcgtctacactgcacggctcagggaataagcactagcacagggagtcaccattgatccgaagtgctgggactgagtcccaaacctggctgtgaatttcccgggggcaagaaagaacagggttgtgtgggaagttactgagcatacatcagcccagaaaaacagctctgcccaccttttcctggggcgcacggagcatgtggataaacggggagaaagcactgccagacaagccccagggcagcggcggtggcacttggccacgggagcagcaggtgggtgtctcagattcggcccgttaatgctgtttcttccacgggcttttgctagaggagcctaacatcagtttaaggcctattctctttgcagattagggacaagataagaagccagtggggaaccagttaagctgtggggaagcacaaggtctattagaaggcttcccttcccacagagggaccctgcagatgactgtaggcaaagccagcctcttcctttaggaagcaacttggaacttgcgccagggtttgaatcaatccctctccatattacagggcatgaaaggaacacccttgatttaaaagtgttgtgaggcaggtgttaacagctgttcaccatggccacaggaagaccacagaaacgtttccaggaaatgtctagttttaagcagtttatcctcaaaggctgagtttgctatacaataattgggatttgggattatggatactgatcacttaaatattggaggatgactaattaaatacagtgacttttgttgttctgatttttagtgctttctcctgataatagatgaaggggccatttgtctcttacgcttcataatggaggcttctgttacatgtctgtgggaagacattcttctcctagtatatccacggaggcagagatgcagttcctttagaaagtgatattattggctgggtgcagtggcgcatgcctgtaatcccagcactttgggaggccctgggctggtggatcgcttgaactcaggagttggagaccatcctgggcaacatgacaaacctcatctctaccaaaaatacaaataaaattagctgggtgtggtggcacaccctgtggtcccagctactctggaggctgaggtgggaggatcgcttgagcccaggaggtggaggttgcagtgagccaagattatgtcgctgcactccggcatgggtgacagagtgagaccccacctcaaaaatgaaacaaaacaaaaaaagaaagtgatataattaataaatttttttaactgttaagagaggaggcactaaaatgcttcctttttcctatacaactttaaattctgttttgaatagagaatcttatctcgatgtgataaagattgtacttaaaatcagtcgccagcatcattctgaacaatgaaacatttatgtctcatgaaaatcaactgcaaagatctccactgtcatcattttgttattattagtgttattttagaagttctggtcaatacgctaagatctaaaaccgaaacaggaggaatgatctattggaaagaatgagacagacttattattcttagataatatagctgtatactttcaaaacctgaaaagaatcaccaaaaagcaattacatttaactaagaatttagtaaaggaactaaccatttttcttatatatcagcaattatcaataagaaactgttatggggaaatacatatatttccctgaaacactcatgaaatatctggaaatcttaaaattaaaaattaaaaatacttttattggtgataattttttacattcatataatcaaatcagagtaattgagatacctatcaccttaaatatttatcgttttcttttttctttttattttttttgagatggagtcttgctctattgcccaggttggagtgcagtggtaccgtctcggctcactgcaaactctgcctcccaggttcaagtgattctcctgtctcagcctccggagtagctaggattacaggtgcacaccaccacgcctggctaatttttatatttttagtagagacgaggtttcaccatgttggccaggctgatcttgaactcctgatgtcaggtgatctgcccgccttggcctcccaaagtgctgggattacaggggtgagccaccgtgcccagcctatcttttctttatgctaggaacattcgaattattttctttaggtatttaaaaaatgatttattcatttatttatttttagagatggggtcttgctgtgttgcctaggccggagtgcagtggctgttggcaggcacagtcatttcacactgtaccctcaaactcctgggctcaagtggtgctcctgcctcagcctcctgagtagctgggaccgcaggtgtgcaccaccacacacttctagctgcttgaaatgtactctcaattaaattaatgttaaccgtactgtcaattaaattaatgttaactgtcatcgctccactgatttatggaacaccaggtcttaggaataatcctaataagaaaggcacaggacttactcgtgaagaaaactataaaaatgttactgagaacagttaaaggtacatttgaataaatggagaaccatattatgttctgtatagaaaaatagaatattatgaggatgttacttcttaacgttaagttaaaattaaacttcattgcaattttagttcagtgcaattttaataaaaatcccaatgggattaaaagattgaagaactgattaatttgaaaaagataagtgaatataaatagctaagtaaaattaaaatttgagggtgaaaaatgacccttccaagtattatgaaatataaagataaattagttaaattaatgtagtactagtagaagtattggttgataggttaatgggatgaatttgattacccagaaatagaattttgtctctgtgagaattaatacatatatctgtgcacacctgtgagtttggggcagattatttaacagggattgacacaactggctagttttatgagaaaaaattaatctttatcttgtatcatataccagaataacatccagacggcttaaagggtcaatgtaaaacagaaacactgtaccaaaatacatgtcttccctcactcagcaggtagttagcacctggtccaggccagggttttgttcaaatgagtggacttgagtctctagcccactgaggagcatccatgggccggagctctgccgggaggaaaggacaggtgtgatcgcagcgttccccagctggctccaccccgatggggagtgtggaaggtgtgttgaggggtatccagagaaggcctccccaagaaattgatctttaaactgagatctgaagagagagtcagagccggccaggtgacccgggggaggggaactcccagcagagggaactgtggatttgagggccgagaggtgagtgtggccaggccgcagtgtaagtacgaggaatgagtagtgagtagatggtccacggagagtgaacaacgcaggcagtgaaggcactctaggagaaccaggcagcatcactgatgtgaacgaatgtaaactaaatcaatacgacagcttttctcattaaatgattgatggttttaaataacaagaattttacatctggtttaatatctggtgggagtgtaaatttgtgtaattttttttgcaaaggaatttggcagaatgtattgagtgcgttaaaatgtttatatcttttgatcaaataattccatttctggagatttatcataaggaagcctgagaatagcccttcctgccacgtccctctcaccacctgtcccctttgctgtgaaaccctgccttcaaagaagggcgttactcctgcactagggctggggtagccaggtgacaggcggaggactggctggagggcaggtgggtagggaaggggctcaatgttctgggggacattttaaaagctggaaaaacacataaacgagttccatattgaaatatttatttatttttttctgttgtgttttcagatgaagacagtcagtgttgccttagttttgtgcctgaatgttggtgtggaccctcccgatgtggtgaagaccacgccctgtgcacgcttggaatgctggatcggtgagtatgcctccctcacgcgctgccacaaaggccgtctggccggctctggcctgggcggggctcgccaagcctgtggtctggtccaggggcccgtctccagctgtgcaaatctgaggggtttttctttctggagtcacatcacctttgagtaatttccgatgcgctcacctgtgattggtagtggagagagtgtttccagaaaaatcaatacagtgatgattattggcttatataattttctactttatttttttatttattattattatttttttgagacagagtcttcctctgtcaccaggctggagtgcagtggcatgatcttggctcacagtaacctctgcctcctgggttcaagccattctcatggctcagcctccttagtagctgggactacaggcacccgccaacacacccagctaattgttgtatttttagtagagatggggtttcaccatgttcgccaggatggtctcgatctcctgacctcgtgatccgcccacctcagcctcccaaagtactgggattacaggccaattttctactttattacacgcccggccaattttctactttatatttgttctgtctggcacacatagtatctatgtacacttaaaaaaaaaatggaatgactgatacctgcatggaaatgtagaagaggtaaatggaaccacttccagcaaagcatcacataatggatcatggcccataataataatggccatcatttgctgaatgcttgtagtgtgtcagacgccactggaagcactttacaatgctcacaacaaccttgtgtggtagggtttttgctaatctccatttgagagctgaggaacatgagacatagagattagtaatttgctcacggttgtcctgtagagctggaatttgaacctatgcagttcaagtccagagactgttttttttttttttttaattgtggtaaaacatagacaacacaaaataccattctaggaattattattattattattattattattattattatttttcattctaggaattattaagtgtacaattgaacgacatgaaataattcataatgttgtgcaagcatcctcactgtccatctctagaaccttttcaccatcccaaacagaaactctgtctccattacacaactcctcattcctgccttcccctagcccctagtaaccgccattccaccatctgtctctatgaatttgtcattctagggacctcatatcagtagactgatatttgtccctttgtttctgccttctttcacttagcataatgcccccaaagttcatccatgtcgtagcatgtgtcagaatttcattctcctgccgcagcctcgcaataactggacttataggcacctgccaccacgcccaggcaatttttgtatttttagtagagatggggtttcaccattttggccaggctggtctcaaactcctgaccttaggtgatccacccgccttggcctcccaaagtgctgggattacaggcgtgagacaccatgcccggccaagatacaatttatatacagtaaagttcacattttttagctgtacatttctttaagttttgacaaatatgtacagccatgtaacaaatgccataatcaatgtatagaatatttctgtcacaccaaggaagttcccttgggtccctttgtaatcgatcccctctcatttctctggcctctggaaaccattgatctgattttttccttttacagaatgtcatttaagtggcgacatatagtttgtagtttttgtatcttgcttctttcctttagcagaatttatttgtgattcatctgtgtagctacgtgcattagtagtttttttcctttattccatttttatggctccctcacaatttgtttatccatttactagttgacagacatttgggttgtttctagtttttggcaattatgaataaaattgctataagcacttgatctttgtgtggacatattttctctggttaatatttaggactgtgattattagctcatatgttaagcgtatgtttaaattttttttttttttttttgagatggagttttgctcttgttgcccaggctgggagtgcaatggcacgatcttggctcaccacaacctctgcctcccgggttcaagcgattctcctgcctcagcctcccgagtagctgggattacaagcatgcgcctccacgcctggctaattttgtatttttaatagagacaggatttctccatgttggtcaggctagtctcgaactcccgacctcaggtgatccacccacctcagcctcccaaagtgctgggattacaggcatgagccaccgtgcctggccaagtgtatgtttaattctttaaggaactgctgaactgtcggttttttaaagatctttaaaaataatgaatgtcttttatatttaccttcatatttattgttttgaggaccattcatttctttccgcagttccaagtttctatctggtatcataatcattctgcctgaagaacttactctaacatatcttgcagtgctggtctgtaggcattaaattttcctagatttctgtttggaaaattcttcattttgtctttgtggttgaaaggtattttttcggggtatgtaattttctgttgactcttttagcactgtcttttaaaacagtcacctgttgtgttctggctagcagtttctgagaagtctgctgtaattctttgtttctctgtatattttgcttcatttttctctggcaatcttcaagatgttccctttatattctcagtagctttatctataacctattagttttttgtttgtttgttttggaatttattctccccacccttttttttttcttttagagatgggtgtctctcaatgttgcccaggctgggctatacttgaacatctgggctctagtggtcctcttgcctcagcctcctgagtagctgggactatggatgcccagtactgcacctgtgaaatttattctttttgggtttctgtgagcttcttggatgtgtagtttgatgtcttcatttttgaaaagttcccattatcttttcaaatatttattgtttgttttctctctcttctgggactcagctctctatgtattgtgctgttagacattgtaccgcagctcttccatgtgtctctctcttctgggactcagctgtctatgtattctgctgttggacattgtaccgcagctcttctgtgtgtctctctcttctgggactcagctctctatgtattgtgctgttggacattgtaccgcagctcttttgtgtgtctctatcttctgggactcagctctctatgtattgtgctgttggacattgtaccgcagctcttccgtgtgtctctgtcttctgggactcagctgtctatgtattgcgctgtcggacatagtaccacagctcttccatgtgtctctgtcttctgggactcagctctctatgtattgtgctgttggacattgtaccgcggctcttccgtgtgtctctctctcctgggactcagctctctatgtattgtgtcgttggacattgtactgcagctcttccgtgtgtttctctcttctgggactcagctctctatgtattgcactgttggacattgtaccgcagctcttctgtgtgtctctctcttctgggactcagctctctatgtattgcgctgttggacattgtaccacaactcttctgtgtgtctctctcttctgggactcagctctctatgtattgtgttgttggacattgtactgcagctcttccatgtgtttctctcttctgggactcagctctctatgtattgcgttgttggacattgtaccgcagctcttccgtgtgtctctctctcctgggactcagctctctatgtattgtgttgttggacattgtaccgcagctcttccatgtgtctctctcttctgggactcagctgtctatgtattgtgttgttggacattgtaccgcagctcttccattgtgtctctctcttctgggactcagctctctatgttttgtgctgttggacattgtaccacagctcttccgtgtgtctgtctcttctgggactcagctctctatgtattgcgctgttggacattgtactgcagctcctccgtttgttctctcccatgtcacaatgagcttttgttagtctgctgataaaccagccaaggaaattctttttctctgatattgggttttttatttctagcatttccattgactattttagtttccatctctaggggaaatgcatattgcctgcctttccttctagagcctctgctgtgttcatcatagttaccttagagtccttgatctatagttcagaaaacagggtcagccctgagtctgagtctcctaattcctttatcatctcttgactgtaatttgcttttccttgctttttttgtgctttataaattttaattgcatgctggacattgtgtgtagaagaacaatagcgaatgaggtaagttgcatagtctatagtttagtaagtagttaactggggttagaatttgttgttgtaatggttatacccactgcaacagcactcttagttcttagagtgattagttggtgcttgtgtcagtcaaggttctccagagaaacaggggcagtagatgtgtgcctgcatgtgtgtataagtatgtatgtatgtatgcatgcatgtcttgtgatcttgaggcagaaatttcttctttctcaggaaaacctcagtttggctgttaaggccttcaactcattggatgaggcccccatattaccaaagaaaatctcctttactttaagttagctgattgtggatgtcaccacatgtatagagtactttcactgtggcacctgggtttgtgtttgattgaattgctgagtgctacggcctggcccagtggacacataaagctgaccagcacagtcctcgtgcattagggtgggtacaggcaggccagggggttttcccagggctcctgctccacccctagcctgagctgtgcctgcccacgtgcctcactgagtggtccctggctttgcctgtctcctggcacaggatttccattgctagttactcagcgccaggctgtggagtggtgggagttctctgtggtcctggtctctctttagtcttaggcaggccctgggcatctgggccttgggcgtagtgcggttgcagtgttttcacctgtcccccagtgatggcaaacgtctgcctcgattcagtgtagaattctgtgcccagggcgtgttctgctcctatcccaggagtaggctgttttgcaccttccctcaccccatcctccatgctcttcacctgtgtcttgggacagtgtgttctatgcccatggtgagcaaggtaggttttgtctgtacctcctcccactccccaggtacaggaatgtgtgcctgttcttgtggactgagggtctcctgctttgcttcctaggggaggaggtctctgggggcaggtggacttcaagcctctccacactctgtgctgcctccagcagatgcttctcatgaagtgggggtgcagtgggggtgcatgcaggagagtgtgagtgccccttgtgcctggaccccctgtgtttccacacggatatgcaagcgcacactggggcctcgaggacacattaccatcttagctggtttcttgtgcagacctgcgctcttcaaagatgggctgtgcatgtgcccgggctttctcggagaggacgggcctgtgggattcggtttgtctgccctgcggtctcagctcccttatgagctcaagaaaagtgatgatgtcagtgattattcagctttctcatgttgataggattggagccactctttccccccagctttctacatcctaagcaaaagcagaagttccctttattgctttaacaaaaactacaaattattctcagcctgggcagcatagtaagagaccatgtctctacaacaaatcagaaaattaggagggcagggtggctgattttgagatgacaggcatgcctgtagtcccagctactctggaggctgcagcaggaggattgcttgagcttgggaggtcgaggctgcaatgagctatgattgtgccagtgcattccagcctgggcaacagagtgagaccctgtctcaaaaaaccccaaattcttctcatctaaatctcatctaatctgaattggaaataaatgttgtttttcctgcattatttggctgtcacactatgtgagggtgttttaggatgacagttccctcaccccttccaggctgcttgtcccccacaccccatgatggagcagctgtgttttgtggctgatttcttcagatgctctcttggctcactgctggctcccggtgactgtgctggttgaaattgacttcttattagccaccatggactctttccacttcatccgtccctcgtcacagctgaatgtaatcagttattttctcttcctctacagcaatgcttatgttaggcttttcgaacaagccttcctcatgcggatccctgtgtgtgctccggggacgggacgcgcaggcccttcggggttgtgtaggtgtcatctgaggatccagttgctcttccctgcctgaggagcctgagcttttatcagagctcaccgccctctcccacacagtctctttgatcagtatttacacaatgttaatgagaatggaaaaactccatgcttctttcttggtgtgaaagatccagcaaatgagatttctaaaacttgagttttaaaagttttcctgcagtttaggaatatcgtctactttctaataatttcaagtgaattttgagtttaggagggcatgtgctttttctaagttggaaaaattttatttggcctttattaaaaaatgggtaggttcctggtcctggtgatggtggttttaacaatatggcataagagaataagaagcctagtgatttgaatcagcacatttgcaggagtgtgtagcagcccacttttattttttagtttatttacttgaaaatttttatttttgtgagataagaccttactctgttgcccaggctggagtgcagtggcgtgatcatagctcactgcagcctcaaactcctgggctcaagccatcctcctccctcagcttcctcagtagctgggactgtagatgtgcatcccccacgcttttaaaattttttatggagacagggtctcactttgttgctcaggctggtctcgaactcctgggctcaagtgatcctcccacctcggcctcttaaagtgttgaaatgaccggcatgagctaccacactaggcccatttttcattttgaaaaaaaagttccaaaagttgcaagtatagtactaagctgtttcctttctgattctctgagagaaggcggctgacatggtgcttcagcacctctgaattccttagtgtgtaattcctgccagccgggagtttctctttccagatgacaacgcagtcaccaaaatcaaggagcattcgcgtggacgtgtgactgccacgtaagcgtccgctgcatgcaggtttgccagtgtcccaggaatgtcctttgtagcgccaggatcctgctcagccatgcgccatcctaacttcctctcactcagtctgaagcagttccacaggcattccgtgaccctcctcaccctggcgcttgaaggtggcagtctctttgttttgtagaatgtctccggtgtctcctaatgattccgtttaggtcatgcttcgctggcaggagcatcacgcagagctgcctgcttcacgcgggctgcaccaggtgatgcggggctgtgatctatccattactggtcatgcagatcttctcacctgattcagctggcgcctgctggacctcatgtgaaattcccctttgtagttgataggtattttcgggaagaagtgctttgagattgtgcaaatattcctttcctcgtgactttcaatttcttcattttgaactcatggcctccattttcattcagtggatttagaatccagtgttatcctttggtgccgagcttgtctccctctggttgttgggaacccattgggccggcttctttggcttctgtcttgtttgcatcattcgtggagcatgtgcttactttgtctcatctagtctttttcccagcctcattcctcttagtggaatgtggtgttagaaactgagatctgggtgccaggtgttctctttgaactggcgtgctattgctcccaggacctctctcgctggacagagcaaggaaatgcatgtgtgtgcatactatgtatgtgtgcatactgtgtgtgtgcatattgtgtgcgtgtgtgcatactgtgtgtgtgtgtgcatactgtgtgcgtgtgcgtactgtgtgtgtgtgcatactgtgtgtgtgcgcatactgtgtgtgcatactgtgtgtgcatactgtgtgcgtgtgtgtactgtgtgtgcgtgcatactgtatgcgtgcataccgtgtgtgtgcgtactgtgtgtgtgcgtactgtgtgtgtgcgtactgtgcgtgtgcgtactatgtgcgtgtgcgtactgtgtgcatgtgcgtactgtgtgtgcatactgtgtgtgtgcatactgtgtgcgtgtgcataccgtgtgtgtgtgcataccgtgtgtgtgtgcatactgtgtgcatactttgtgtgtgcatagtgtgtgcgtgtgcatactgtgtgtgcatactgtgtgtgtgcatactgtgtgtgtgtgcgtactgtgtgcatgtgcgtactgtgtgtgtgcatactgtgtgtgtgcatactgtgtgtgtgtgcgtactgtgtgtgtgcgtactgtgtgtgtactgtgtgcgtgtgcgtactgtgtgtgtgcatactgtatgtgcgtactgtgtgtgtgcgtactgtgtgtgcgtactgtgtgcgtgtgcgtactgtgtgtgtgcgtactgtgtgtgtgcgtactgtgtgtgtgcatactgtgtgtgtgcgtactgtgcgtgtgtgtactgtgtgcatgtgcatactgtgtgtgcatactgtgtgtgtgcatactgtgtgtgtgtgcataccgtgtgtgtgcataccgtgtgtgtgtgcatactgtgtgcatactttgtgtgtgcatagtgtgtgcgtgtgcatactgtgtgtgcataccgcgtgtgcatactatgtgcgtgtgcttctctctgtacacatttgtctcagcgtttctgtacctctctacatgtacattcatgcctcctattccacctcatgggggttttccatatttgtagctccatcttctgacagtgacaaccttggtatcctttgtccttattgtattggctaatgtggtgcctcctcctgtgtgaaccctcttctcctctctgccattgctgctcctctcagacccggttatcctttgccatttcaccccaatatctgcctttctcactgccctggtccaacacccatatggtcacctttctgcagccacacctctccttcttcctctgcacgggctcagggcccagtcagacttgagagctcattccaggccagtgtggctcccatcatcctgagacagatgccagctttgcccagacccaccttgtggctttaggattgttgaagaagggattttagcattttcaacaagtgctttaggtttcaggcctggtcagccgagggaaggatgatacaccagtaaccaagactgggacgggagctgggctggctggcagatggtggggtaccatttcgcacatggtgaggtgcttgtaggaacctccaagcggagccaccatccagtggaaagtggatctggtgggagaagagggctcattgtagactagaggacccaggggaggtcagcgcctagtacgaactagaccagagggtatcgggcagaggcagggccctgagggtgcagagaggggtgccaaagaggaggaccagggtggttctggatgagtgcgtggaggagcttctggtcagcattgtcaaggctgaggtggtgtccaggctgattgtagcaacctgaagagtgaaggcagatgaggtggtgaagcttgtggggcagcttggccaggaaggtgaggagtggggtactagtgttggggctgggctcagtgatgggtttgctctgccttcctcaagatgagaatgacgggggccatggaggaagccaaaacagggattggtgcaatcaaattacttacaaacatgttaccgtttagaaggcagacctcaggattttatatttggtcttagcattttgaggtctattactagaaatcgagatttttgtgttaatcaagactccagctttattccttccagctgtgctacacatttaactgttttgggcctcagtttcctcatctgtaaagtggagctagtgatgccgtgtacctcatggcagggtgggggaattaactgggagcagagacctggtttggtgcagagactggtcctcacctccgccgccccaactctagtccctacttctaccccaacatcacaacacctcaaacaccccgacccctacgtcacagcgcctcaagcatcccgacccctgcaacactgtcttagtctgttgttgctgctgtaacagaatacccgagactgggtaatttacaaacaacagaaatgtatttcacgcagttctggaggctgaggagtctaagataaaggcactggcaggtctgttgtctcttgagggccctgtccatcttccaagatggggctgtaacactgtgtcctgtcacggtgaaagggacagaaaagcagaagtgtgcgtctagttccctccagcccttttatgaaacacgatcgcctcctgaaggccccatctcttcatactaccacattgggcttccgttccaacacgtacatttttggggacatattcagaacatagcactagccccagtatccccactccagatcacccacacccccgcaacacgccccagtaccgccactccagatcacccacacccctccccaacacgccccagtgctgcatggggagcaggggccaaggtgctgcatgagctgcttcctgaatccgtgcctcttccgctgctttctgtagggctgactacgaaagagggctgcagtgaacacacctcactgagccccactgccgggcatgtagccttgcaggacggccgctcactcagggttgaaggtctccagcagattctgggagtagatgcacggtgctgcttatttcgttttacaaattaaacatccaatatgcaggtagcaatgtgtgtgaatccccagtgctttatgtagaaccctgagtatggggttcatttttgggcagggtggggtggagcggaaggtggtctgtgctgatgtcagaggggtctgagaagcttgaaaaataagggtaactgtgtgtgcctgaaccatgcaggaagacagcactccttccagagatgagggagagcagacgtcatgtctgtgagcaaacaaggggcccatgcccagcgtggctctgggtgtcatggcctccctgctaggtcatccggatgaagcctggggctgtggagtcagctcgtgagaaatgggatccaggtcctgagcgtgctggaactggcgagacggggtcacagcacacacctgcgtttccagccctgcccctgctgacggccaagacctcttttcccacccctgctccgcccccctctggataataagttgctgttctagttcatagaagtgacacttgtcccttttcagagaagcaggggagaggctgttttgttttatggcccgacattaaatactacaacagtaatactaaaaacaatcctgctgaagagctgcgcgtgccccactcttggggaactctgctgtggcagcagagtgcggatgagctgcatgctgagcagggagtgtcatttagcggaaatggttttgtgtgccagctaatggtagctgtgtatcagaagaggtgagaatgcaaaggtttgtcagatgtgtggaaattctgtcatcccaagggaacgtttgggaggtcttagctttgtttttctcttcttaatgcaaacacgtgagcattaagagaccttgggtagatgagctgaaaatagtcgtgatcgcccttggcggcggctcgtgggtttacagagcacttgcacagacttcgtcattgattcttgcaaccatttgggattcatagaccagtcaagttggttaacagatattgattaggtggaaacgtatatgttaagcatagtgccatatacaaggaactgtaagctgtgctcttgctttcaaggcactgatagtacacctggggaggtaagactaggatccatgcagtagaacagagaccaatacgaggtcaagcttgaacggcctggaaggccagagaatgctgcggtagagacgtcagggcaggcagtgggaggcaagagcaaagagctgaaggaagagcatgagcccacactctgaggtccgaggggctgggttttcgcacaccagctgggctccctttgggcctggggggtcagtagcacccgttagccacggccagtcacagccgtatgctctgtgcacacagctctgtgcccacagctgaaaccttggctctttggggcttatggtttaaaatgctgttttcttttcttcctttcttttttttttttttttttgagacggagtcacataggctggagtgcagtggtgtgatcatggctcactgtagcctctacctcctggactcaagcgatcctcccacctcagcctcctgagtagctggaaccacaggcatgcaccaacacgctgattaattaaaaaaaaattattgtagagacggggtctcattttgttgcccaggtttaacatactgttttctctgccagttccattggtgtctcaaggtggtatctctgcttcccctctgaaggaatctgaaagaagggggttaactgcttggagcccacctctctcctgtatctactttccaaagtgaggacagttttttaaaacaggacatgttcatcccctcatatctgctgaaaatccgtctagctcttggtttttgtataatacagcaataggcaacacaggaacgtaattttgtagctatgtgaggagtgaggcctagtgttagaacggggccagactgtaaaagatctcgctcctgtacggctcccgtcctagtcccacagacgctgcaagggccgcgggtcccggccgaagctttcctgtcccagatgcctgcagctgtgtggctccaagctttgcgcctgagctgaggaagatcacacgcctctcactgtatacaggactaattattacaaaatagacagggatggcattatggttaggaaaatatagactcattaaaaatcatttctaatttcaaagtagcccctttgctattatgtattttctcagtcaaaaatgagttgtttaaggctacacaactaatgagtggcagagtccttgaaaaccacacagagaaatttgcacttcatctagtaggcagcactcaatatgtcaattaaaaatgtttattaagtgtctgctaaatacacggtacaaagaactacaaagattgtccgagcagtgagtgctggatggggctttcagtgtgaacttttcactgaaggatagcacacagaggaaactgcacctaacccgggtgtatcctaaactgatcatacccatggaccccagatcaaggaacaagatgaccattggcccagaagtcttatcttgtcccctttgggtcccctcccccagctgcactgctgggtctccactcttggcagctttccatctaaatggagcacacagcccgcactgtgggcttctgaggggaggggtcagcctgcgctcatcttcagggtggactgagaagagaaagactaggtcattggtggccctgtctgtgcctggggcaccactctttggggccattgggccagattgaggaacccagctgggaggtgggagagtctcagtagcatcgtgaagggctgcggattgggtgaacatgttagcagtggctggtggagtgccagctctttggaaggtgaaatggataggatgggtaatcaaactgggtacataggaagaagatggagaggtttaaaaagaaaaagctgcaccccttcaggttggctgaatgccagcactatcaataaccttggagcaagtcatttgactgctttaaacttcagcttgcccttctgtcccatgaggtgggttggaccaagttcctttcagtgtaaagttctaagtatcttgaaattcagaggggttatgctgaaaatcttgcaaataggaaaatttataaagaactaaaagttttatgcaaataccatttaccatctccttttccatccacctacccatccatttcattcatcaatttacccacacactcactcgccgctgaagtttcattagttctttcccagattccccttaaataggagctcataaaggaattagaagagaaatgttttataagacacaactacagttttacatttatgatctgtccacttcaccccacatcagactgatactgttgtcaataatatctatcggggaatttaattttagtttatttaaattatacttaatcaaatgctaaatgcatcgtttcatttgacctcattctttcccgtctcttcctctgcttctcatttcagctctcccacccactgccctattcttggaagggaaccatacaattaactgaccacagggattcccagtggataggcggttatagtgccatgtagctggtcacggcctggtgagcagctgacagtggtttcacccctcctgggtgggcaggtatcctgacctgagtcagggcagggagagtggggcccctgccaggctgtctctactaacgagggccgccatgtctctgcaggatgttgtgagggatgcagggaagtggctgcctcctgccaacactggggagagggtgggatgggagaagggcctggactttccaaggggtgaaatccaaggagggggtactccttgaatgggaactccctcccttcttcctctgtccgtggttcactggagagcatgcatagtgtgagccaccgctgaccgtcgtgatgcatggacagttttctgaccatagatgacagccgcgggccgcgaccatgctggttgctgcagttaagtatgggtgactgaactcaacgccttccagccagccctgtgcgtttactttgctcctcctcatgcatgcggcaaggtcgctctttggcatctgtttgttaaagctgttttttgctttcctttgccttgtttgtgtacttcgtggcccctattttttgtttttcagatcccaatccaatcctatcttgtgggtctgatcacagcacagttgatttgggtcactatgatttttttgagaccttagaactttgttcctgagagaaatgaagaccaaacatgtaacgtctgaagtcacagattacggattataacaaatttaccacaattcttccagagaagttagatattacctggtttttaccaagcttttctcagccagaggtgtccattgaattagaaccattgaattagaatttccagaaggttagggcctggcatctctgttttgaaaagcccttgatgactttgacctatctatgggcgaaggccctttccagttgtaaaatcttattaacgtcatgatttttattttatttttttatcagagtaacatacatatagctaaaaaaataataattaaataatgccaaaaactatacaggtggctcttggagatcctgcgggtgtggctctagacgactgcaataagtgagctacatgaacgttttggtgtccagtgcatataaaagttacgtttacactgtactgtagtctgtgaagtgtgcagtagcattgtgtccaaaagaacatacacactttattttaaaaactgaaaaatgttaatgatcactggagccttagcgagttgtaatcttttagcatttaattggctgacggagggtcctgcctcatgtggatggccgccaactaatggaggaggggtggttgctgaaggtaggggtgactatgggaatttcttaaaataagacaataacaaaatttgctgcattgattggctcttgctttcacgcagcatttctctgtagcatgtggtgctgtttgatagcattttacccccaacagacagacctggagtagttggcagatgttttctggaaaatgaatgacatgagcctgtcacattaaggaaaacaactgacagtgtttgtttccactgataaaatttgagatttcaaataaaaaaaataaaatttggaaaccttgtacctaccactatgagcctggcaacttcttttttgttgttgttgttgttgtctttgagatggagtctcactctgtcgcccaggctggagtgcagtggcgtgatctcggctcactgcaacctctgcctccagggttcaagtgattctcctgtctcagcctcctgagttgctgggattacaggcgcccagctaatttttgtgttttcagaagagacggagtttcatgttgctcaggctggtctcaaactcctgaccccaggtgatccacccaccttggcctctcaaagtgctaggattacggtggtgagccaccacacctggccgagcctggcaacttcttagtacttaagacatttctgatgagctcatggtaatgttaatgagtgtggattcttaaaaaaatattggggaatgaaatatacaagatctgtatagttcaatgagctgatattttccagatgatcaatgcatgatgatacaaaataatctatgggtaaaaaatccactcaaggtgcagcaaacagcagtgaattttaatgtcatagcatacaaaaagttcgttgatgtggtttcagatactacatctcatataatctgaaggaaattaccacttgataatttttggtgtagtatcaaacaaaaagagtcatgattatgtaaaatagcattttaagatactcttctgttttctaatgatagatatatgtgtgaggtaggggtttccacatatgcagtcactgaaaccatgaaatgccacaggcgaatgcaaaaatggatgagagtcacccatccttgatcaaaccacatattccagaaattcgcaaaaatatgcaaaaatgctgctcttctactaaacttttttggaaaaaatagttatttttgtaataaatatttatgttaaaatataatgggttattgtttttaaaatgaatgaagaaaaatatttaaaaaatcttagctgaatttcacatagagtagatattgatagattcaacaacataaaccaaagctctttgaggttttcaataattttagagtgcaaaggggtcctgagaccaaacaagtttgagaactgctgatttagagttaattgccctggaacccactcctgaaataaatgggtaaatcctggacatgaatgtacatttgtgaaacggattttttttgtgggaatactgagtgcagatgaaaattaattaaaaagtatcacttctttgtctttttctctcctccttttcctgtacccatgagagccatagtttgaacaggaggaagcatatgctgtcactgcagagctgccttctcagagaaagcctgagcaggagcctgagaataaaacagtgcaagtgcgggaaagctgcaggtgccgaaatacaaatgaacgtgggtagaataacagcattcacttgcccgtgatgttaaaacactggccttcacggcgtgtcagcttgtttgagcaccttagctgttcagtaaatctggttaacactgatcaaccttaggcgttgtgttacttttagtcaaaggtgactttgaagtgtgttatataaggagaaactgtggaagagaggcctagcagaggaggaaatgcagacgtaaagaactttctcttttccattgcttcctcagatcctctgtcgatgggtcctcagaaagctctggaaaccatcggtgcaaatttacagaagcagtacgagaactggcagccaagggtaagtgtgcttcacttgctcttccctttccttcttacagggaaactccagttccttggtttccaacactctttggatccaagtgagaattctgtgcacaccctgcccttgtgtggcatggcgcctgcgcactgcgtttcgtgtgcctgcgttctgcctgctggctattggtggctgtgttgtcttgacagcgtccgcattattgtgagtcttgcattggacagtccaacttattttgcttaagtttgttccagatttttagaaaagaaaaagtattcttttcgctcttaaccatggttttaatttttctcaggaaatgtattttcgataatttttctgcaacctcaactagttaacgctattccgcgtgtcttcagttttcacatagttgagaaaaaaacacccaacagtcaaaagataacacttattatatgctttgcctttgattcaaaagataaggttctttttagggagccagttaccaattagtgtgtgggtttttttttttttttttttggcttatatcttacagttttttgtttgtttgtttaaagaaaagtggcttagaatataactgtgtcaaattgcctttaagatcttaagttacttgtaatccacccaaagacctttagcctttcttattaactggtttggagatttaataaatttaataaaaaactaagaatctgggcacttatggaagtgccctatattcagctttgcatgatagatggactcgagttacctaaaggaaataatgaagaatgcaggttgagaaggtgcgcgtctcctgcaagttttactctccccttttggatgaaagcctcatgaaaacacatgatttatggaaccttttgaacacttatttggttggaattttgatttgtggatcatttatccacatgatgtgggatttagagattccttatacattatttacattcttagagtaagagaacagccaaaaatgaattttttcctgcctttaaaaatgcccttaggtcatttctgctgttgcttccagtcatgagctaattgttaggaagcatctctgtgtcttagggtgtacctttgtgcttgcattgccaacttgtcaagtcaataacagcagacttttgttctttagaaggcagtggcttcatgggttcttgactgatgcctaatggcttgactttttcctctcttaaattggttgcctcttgatggtttgtgtacacatgctgtagcctttttcttgagggcgcagtgcgtttggggatggcatgaggactggagagagatttggatggtggagtcctgtaaaaatgtagttgagatgcctcgtgttttccatagataatagcttctttgaagactttgaaggtaccctagggtctcagcatggtgagacgggcacttgcaggagtgtggggcagagtggcagtattagaagacatggccgtgttggcacatggcatgtcgttaaccaacactatgggaattcagaggaatgcctttctggctacttctggccatctcctgggtttggctttgtacctttgcgttttactagatacctttgtttaaaaaagaatgtaacccaataaattcagatctaccaattgtgttctttctagaatgagtctctgctattaaaactagtttcttcttttccaagaattattagataaggaaatatagcctttcagaatacatgtgtttaatatttcaagatattgtatgtgtattccatttgctctgatttacaattgttttttttgagtgctaagagttgatttactgctggctttattattagtttcgcttggtagatatcagctagttgatgctagctgacaggaaatggaatcttctaaagtggcatctgttatttttaatctaaatttctgtctacgagcagatctctccatggcattgagaagcggcatcatgatgtagggaaggtgacctttacatgtaggtcagtgatgacagccagaaagatgacagtgtagactcagtacaggatggaggattccctgcccatgacagtggcacagttgtattcggacagcgagcacaggtgcaaaggggtgcagtcctctgaatgatctgtagtctgggaaaatttgttaaagttggccagatttcaagaatggatgtgcaaaataattctctgagtaagagatcgtttgaagggctggtgagatggagaatgtgttaagattacaggatgcttcggaaaaggtaccagcgcaggcgggatcccatctgggctggtttataaagtggaatctggaataaagtatccgctgcagcctagaaggaagctgttcttgcacacagagtgggatcttttgtccccattcaggaagcaaaaccacaacaatggacacctaatatttgcttttcgaatgccaacaccattgcattcattttttagtacaataaaaatgtttaaaaatttcctgctactatccatgagcgggcctcatctattttagaaattagcctaaggtaacggatgtcacaggatacctctgaccggctcccaggtgtgagcgtggggctgtgccatatgcactgggtaataatagcacttgccccggtgcgcgtggcacactgctcctcacagctttccgtgggttacaggacagagggagggaggcctggcatagatagcgtggctctcagtgtggggcagacctcatgctgccttctagagtttgcatgaaacaggaggcacttagcaaactcagatgtttgtgtgcaaggggcctggttcctgactgtaaatcagggtcctttgaaacattgcaaggctaaacacgcaccacttgattgcactctacagggctcttgagtttctgcagtaataaagagaggttgatgtgccatctgcaataaaacaatgggggcgttattaaatttcccagaccttcagtggaaagacccatatatctggttttctctttctctgtgtctttattgcaagagtggaaaaccttgggtcatttaatgaaaatgagattattttcattaaagtttgtcggagtcgttgcctccacgctggcatggatgggagcagagtaggaaatgcctgttttctcaacggtagcgtccatccaggaggtgcagaaagccaaccccggaacccccgtcggctgcaccagaatggtgtctggaagcctctgatgatttccttgctggtgctggaacgcttggacttgttcttcatttttctagcttttgatataggtgattccagttcaaaaggaattgagagaaaccatggtgattatatttttttctgaaggctgccagccactatctggcccgtatttccttgcttaggcccattgagcccttttctaaataatttatcagtttgccactgatgaaatgtttcttctgattaaatttaaggctttgccttattaccttgtaggtgtataaatttgtgttctgccagagattggaggaaaatgccgaccgttgtttcagtggaaaattctgcagtaaaacctcactcattccatcataagtctcaaatgaaagttttattgggaaatgggagtaggagattattataaagctgggaccatacagtgaagaatttatctttttagagaatttttctaacaaattggggctactggcagtttagtacaggatggaagttaggagctggagcctgtggaaaaagacaagcaggaggggcctcgctctctgtgtccttctttccccagagagagtggacaacaccagaagcagaggccacacctctttacttggggtgagctttaattcttctggtgccttaaaaataagtttctatgggaatatctatcatttactaaggaagatgaaacagcatggcggtgcctccactgaccaagtctgtccgtcgggcaggtgtgtctaggggaggaggcggaaggcgctcctcagtcatggagccacgttgttgtaggagctcattctcatcttgtccaggtctgcgagtagtgaaggcagcaagtcctgtgtggcggccgtggggcttccagggagctgagcggtcaggttgagtcagtttccatgtggtggacagttcttacttatccatgcacagccctggtttgtggattacagtgaacagattttgaatgtcagcttcccttcagttcaccgtgcttctcagatgtgtcacagttaatttgtggttaagggatgaaagttggttttgccattagataaacatgttttttatagtgcctaaccccaagcagagtatgttcaaggagagaacaaaacagctcccaagatctggtccattagcccagtagaaattgttattgcattttaatgtaaatgacagtcatcctttcgtggtattgataatagagttgtttgtgtgcttttatgagatgctttgaatgaaccgaagctgatgactatacctcctgttgggaggagggggtttggggagcaagggggttgagaaggccagtggtgggcagttttggttctacttaacaggtgtgtcttttggattttaggcacaagtgttatttgcagaactgaatgtttatgtgtaattccatgttgtttaggggtttggagtgaggataattggaatccaggcatcttctccttgtccctgaatggggctgctgcttgacctgtccacctcacagggagtgtcatgtggccatgtgtgacaaactgtgaaacccttggtattgagtgctcacactgctaggtgtggtgggaggcgcctagtcaggcagccgggttggctttggggagcactgcatggatggcttctaagatccacttgtcttctttcccctgggatgattagacaggcctctgctttgtgggcaaagcaattggtatcagcacaagtcactcgcttccttgtgccccccacccccaaatgttttggaatgaattttatagatggatgctgatatggcttggctgtgtccccacccagatctcatcttgaattgtcactcccacaattcccacgtgccatagggggaacccagtgggaggtaatcgaatcataggggcgggtctttcctgtgctgttgtccgtagtgaacaagtctcacgtccctgcacgagctctctcttgcctgccaccatccatgtaagatgtgacttgcgcctccttaccttccgccatgattgtgagaccttcacagccatgtggaactataagtctattaaacctctttcttttgtaaattgcccagtcttggttatgtctttatcagcagcatgaaaatgggctaatacagatgcagtcaagacgcataaatcagtgggttctaccttttcttaggattttcaggctcagatatggataatcggggaagaagcagctaagttgccctaggacagtactccacacctggaggtgctccaaagctattcatggaacagcccaaggtggaccgttactcgctgtgactcctgcttggggcattcacgttgcgacattagttccaaattgacagtccagttcagctggtgaaaatggccctataattgcgattggcagcatcccttggcgtgcggccctgatgccattaccattccatcatccatcccgtcttgctgtctgccctgccgccagccctccctcctcctgcccaaactcacctgactttcttctctgtgggtcctaaggttgggcttcatccaccttgagtttctgtgacaagctgccagtgaggactcatgggcaaaggcagaactgtgggtggatggctcacagcttgcataattcagtacctggtgtgaagcactttgcctgtgtactcattaaatttgcaggacggtacagacaatatcttctggtggtcttggggttaactgtggtgctttgacagtttcacttaactgcttactgcccagaaagttaagaactgttcctatgatcaatgtttttacttatatttttgccttggcctcagcagtgctctcccacttcgtcttccctcctttctagtgcttctcgcctgaaagcttttccacgtgcgtgccgtgttcagtgagaactctgattcatgctcttcagccagaagccttcgtagtcagccctgcccacgcacttcctgccttgccctgtccccagaggccatggtattggaagcagcttcctggaagcaagcttagattatgcgaagcagtttattccggactctttagaccaattgcaccagagcataaaggtgttgtcacctactgctatccctccgaataccttagtgacatgacctataaattcttttaggcacaccaaagacattacagaaagaagaatgaaagaaaggcatggttctgcagcctcctggaggatggcagcctgttgtgactagactcctcagggtttcagtccattagagctggtcccagaggggacccctgctggccagccctgtgttggactcttgctctccgaggccacctaggggattcactagagagcccatttgggattgaagagcacgcgtgttgactagagtgggttgcagcatgggccgcagcctgtttaaacactgcctagggaagattggtggagtccgcctcctcccttctgcctcgtaggtccgcagagtcgtgctgggctcaccgctccttccctttctgggcgggagcgcccctctcactggtaggggagctccctgggaaatgtggtctcctttctaccagtgcactgaggggtggggtggggagagcttaactgtggaaagaatgcgaactggtttagttctggctttgccacttcttagaaatgtaactctggacaaattactatttaaacttttaaaatttgtacatgcaaatgagagttaatggacagaataaaagtatataaagcatttgcaccagggaggccatggtggttggtcatcagatccttacttcccatccctttctgtcccttatcccttcctctccctcatggttgaggtggtggaggcccctcccagaacattctgcccaggagtcttgctgccttaagcccctccccatcctgccttatctctggttttatcctcttgcggggataactgcattcctgactcttcctctattaattgacctacttgaagtgtaatacttttagagagaagtaggggcttaactctgtccttaacaggcctctcgaggatattatctctcatcatcatgttccctttaacaagggagttgtctgtgtgtatgacaaattgcaaatgaggaccccccaccgtcaggctggggactaaaactgtagctcagctgttgtcgtttcacagatctcacgtgccatgtgtgtttcctgagttaacttggggaccgtgatacagagcgatgcggagatggctctgaaggacaggcaggtgccaggcgagggatggaagtgctgcttctaagtcagaaagtggaaggtgtgatgtgttaaagaatggaaagctaaatttggaggtgacgatgaggaacccaccgtatgctcgccatatgcaactaggaagagttgtaaaatcctgctccagccaaattggaaagtgctgatcaagggggaaacgatcaataacagattggagggggacggccacttcaaagtgtctgcggtacttgatttcattttgcaggggaaaccatatgtcacagtggtgttcatgaatttgggtgttcacaagggcttctgtacagctccctcccaaatgtccgcgatttacttgttggtatgacacataatggagatttttttaaaatggacatacgaagcacataacgtcaagttcaccattttaaagtgtacaacttggctgggcgcagtggctcgcgcctgtaatcctagcactttgggaggccgaggtgggcagatcacctgaggtcaagagttggagaccagcctggccaacatggtgaaaccttgtctctactaaaaatatttaaaaaatggccaggcacggtggctcacgcctgtaatcccagcactttgggaggccgaggcgggtggatcgtgaggtcaggagatcgagaccatggtgaaaccctgtctctactaaaaatacaaaaaattagccgggcgcagtggcaggtgcctactgtagtcccagttactcaggaggctgaggcaggagaatggcatgaacccgggaggtggagcttgcagtgagctgagatcacgccactgcactccagcctggggcgacagcgtgagactccgtctcaaaaaaaaaaaattagctgggcgtggtggcgggtgcctgtagtcccagctattccggaggctgaggtaagagaatcgcttgaacctgggaggtggaggttgtagtaagccgagatcacgccactgcactccagcctgggtgacagagcgagactccatcttaaaaaaaaaaaaaaaaagtgtacaactcaattggcttttaacatctttgcaatcttgtgcaactgtcataactgtcataactgtctagttccagaacacttttcttaccccaaagggaaacccaaagcccatcggcagtcatttctcctcccccaggcccaggcagtcaccagcctgccttctgtctctggagatgcctgttctaggtactccacacaaatggagccatacagtatgtggccttttgcgtctgggctctttccttagcatctggaatgttttcaagattcctccatgctattgcatgtatcagtaatttaatccttcttgtgtgtgcatgtgtagagatagggtctcgctttattgctcaggctggtcttgaacccctggcttcaagtgatcatcctgcttcagcctcaactctttctatagctgaaaaacattccattgtatggctagtctacatttctattttatgggttcatctgttgatggacactttcatggtttccaccttttagctatttgaataatgccgctatgaatatgtgcatgctagtgtttgtgtgggcccctgcccactagtggggttgctgggtcatatggtgaccctgtattttacctccctgaggcactcccaatctattttccacagtggctgtactatttgtccatgtctactagcagtgtatgagggctccagtctctccacatcctggccaacatttgtcactttctgtattcttacattgttattattatgatagtcctagtgggtatgaagtggaatctcatcgtggttttggttttcatttccctgatgattagtgatgttgccatcttttcatgtgcttattggccatttggaggagtctctattcaagtcctttgtccattttttagttgggttgtttgtctttattgttgagttctatgagttcaaaatggagacttttaagttgaataaggtataatttctgttgtgaggacttgtttcctttccaaataatatgtgtggtgtctgctgagagcctcatggtaacatttaattcttaaaagagcctttgtcttgatagattggtttcataaaactgttaagaggttcagccaggcaccgtggctcatgcccgtgggaggccaagacaggaggatcctttgagctcaggagttggagaccagcctgggcaacatagtgagaccttgtctctaattaaaaaaagaaaagaggttctttgactattgactatactgatcatatatatactgtataatttaataccaatcccttaagattcctgtgtgtttttgttaggagtcttttggttttcttagagctgtggtctctccacctggagtgtatgtcgggagaaagctcctgtcggggtgagtgcaggcagagtggccgaggagctgggcctctgtgaagtctgggtgcagcttggaggctcatagtggactgggagcttggcaggaggggcggtgcatgtccacaccagtgcccggtctccgccgtgctgcggccctgtgggtctctgctccccactcagcagttacgctgcaggacgttccttcccctccctgtgtgtgagggctgggtccttcctttctgatgtagtcatctttgatgggactccatctgcttgggcccaggggtccccacaggagccagctgtgttcacatcctagtggtccctggtcctaaaccacctcctgactttcctctgttgcttcagcttcagctctctgcccactgcattgtgtcgctggattttcaagattaaattccccccacaagagtgtttgatgcttccctggatggccaggctgtacggccagtgttaaaagacagacaagtgccacccaggggcaaggggagtgtgtggttcaaagtccctgagaacagatgccagatgccaggctcaggtggtgccgtttacttccagcaagaggagagagagggtgcacttgatccagtgccgggtgatggtggcccctaggccagggggtcgcaccctcactttgggctacagtagaaggagattcccccaccccgtggggtcttaaacacagaaaactgggggcatgcctgagggccactgatgcaggtgctaaggcacaacagaggagccatggaggcagaaatcgggaaagacccctcccaggtgagggctgcacgggctgtggtgagggtgctcccctcggtgggctctcggcccagcacgtggaagacggcgcagtccactgccttcccaacccagagaggccgatcagctccgcttagcttcacgtggtcctccgtgtaactggcccatctgtgggttggttctgagggagtgaggctgccctctagaatcacctgtgactggagggctgggtggcaggatttaaagcgcatagcagaaccgggaggattacccatggcttgtataaggaagagtctcttctaaagggttgcatgtgtggcaggctccttaatcaacatgctgcttaccccggactggaacatgccctgaagtcaagtcatttttgtgtagaatttttaattataagttttatttttataaacaaaaatcttagctgaagtccaataaaatccaagaagaaggcacagataatcagggagaagtaactcaagatttgaggaaatcaagagtcataaaagagtgctttgcaaaactttgcagataaattggaaaacttgtatgcgatgcataattttctaggaaaatataaatgaccataattgacctcagaaaagatagtaaagaaaaataaatggataaacatagaagaaagagaaagttaccaaaccattcctcttctaatcctcctccctctgaaggatttcaaacttgaaaagaacacaaaattattgaagacttctttctgttgtaggaagatctctaaaacatagtttctttatctattaatttagagacagagccttgctctgccatccaggctggagtgcagtggcatgatgttggctcactgcagcctccatctcctgggcccaagtgattctcctgcctcagcctcccgaatagctgggactgcaggcacatgccaccacacctggctaatttttgtatttttagtggagacagggtttcactatgttggccaggctggcctcaaagtcctgacctcaagtgatctgcctgccttggcctcccaaagtgctgggattataggtatgagccatattttttgttttttttaaatttatttttattgatttgtttttatatttttagaggggtcttgctttgttgcccaggctagagttcagtgatgcagtcagcttactgcagcctcaacctcctgggctcacgctatcctcttgccatatccttttgagtagctgggactacagatgtgtgccaccatgcccagctaatttttaatttttttttttttttgtagaggtggtgtcttgctttgtcactcaggctggagtgcggtggtgtgatcatggctcattaacctcgaattcctgggctgaagtgatcctcctgcctcagcctcaggagtatgtaggactacaggtgtgagccacagtgccagcttaaaatacgtcaaatttaaaatgcaaaagaagaaagtgtattcaacaggtttagtgtatgcacatatgactgatggagtcagccgttcctgcttgtcatatgtaatgtgtgtagctgggtgtggcatatgtgtacatgggtgggtagatccctagatagatggagggcaagtcggtggatctgcccctcctccactcactcagatgccttagagtgaacacggaagggagacatcagcctgtggcctccttagtcgttctcattttccttcgcctcttggtgtcttgctgtgttgactgattctagttttgaaagcagcatattgggtcaaaatacatttttttttctttgagacagagtcttgctctgtcacccaggctggggtgcagtagcgcaatctcggctcaccgcaacctctgcctcccaggttgaagcgattctcctgtctcagcctcccgagtagctgagattacaggcatgtgccaccacacccggctaatttttgtatttttagcagagatggagtttcaccatgttggtcaggctggtctcaaactccttgtaggtgagccacccgccttggcctcccaaagtgctgggattacaggtgtgagtcaacacgcccggcctcagaatacattttaaatcaggtctgtactgacttcagaatctaactccagaataaaatttgattctaaggggcaacagtaccacaaatgaggcgaagcacagaacatctgtcaccgtgacttggggcagatgcagaatgggactttcacctttttacacaaaacccttctatgtgccttctgttttaaaaccatgattttttttactttaataataggcaactaatttaaaatacctattcaccatgtgtcatctcagagtaggaaggggactgtgaggcagacggagccacttgggacttttgcctttgggttgtgacatttgtctgtaggttctttcacttctgtccatctcatttgtttctgtgccatgcgtgtgacatgatgagctggaaagactttgcatggggcccacgtgagtgctcacatcgaaggggcaagtgttaatcaccctctagttgacagagctgtttcagggatggctagttcctctgtccggaacacttgtattgagtggcagggagccgcggggacactgcccatagcggtgggagagcaagcaggaggggctctgcccagggctgtttcctttgcctttgtttaccagcataaagtattaaaacagctaaattatcatgggcattttaatccaatttctcagcgtttcgtcatttgaagaatagaagtctctttgttttcacagccctgttcttgcttgtttaaatttgaatatatttctattcattcagctgatagaaattctttacttttaaactgagggagaaaaaagaacagattgactagggatcagaatgtgatttcagtgggtctttattgggcccttgttagggaggggtttggacctggggacttggagtctacactgatggcagaagcaagctccagaaaagagcaggctccagctttgcaaggtaaaccttggagagtgtagttagggtgacagccagcacctctccctgctgagtggagagggaatccagatttttaggatcttataacctgatatttttcatgcctttgactcctgtcttggtctgttaggtcttggcttttgatagccaaagtaaccagctgactttccttctttttttttgaaatctcctttactttttcacaaggctgtttctcagtgtgaatatgttgctttcatattcccagagcactcactgaatgcataaaggctaagcaatgcagcagtgatactactaaccagctcttagtttactgggtgacctttggctggttctgtcgagtggccactctacctccagtttgccctgtctggagatgcagccaggactgtagattcccaggggagggctgacttactggggcatttatttactggataggggagtttttaatcttttagttggaatatttagtccatttacatttaatgtagttattgatacactgtgtatctggggttaaatccaccaccctcctatttattttagttttgtctcacctgttctttattttttctcttttcttgatttcttttgcattaagcagtttaaaaaattattccattttctccttctattagtgatgtatcagagaatacataagctacatatttgtttcgtggtaaccctaataaattactacatacccttactgtgagaagtgttgaagttagcacttgcaccacttggccagacagtgcaagaatcttgatgcatttaaccctcctacccacccccctttactttgcatggtgtcaacatcatggggttggagtttctatgtggattttaaaccccacagtatacagtcaatatttatttagatttatctgcttctttacacttattaatgttctttattctttcctgcatttctgtccttctgttcagggtcatgtttcttcaacctgaaaaacatcctttaatatttcttttagggtgaggctgccaacaacaatttagtttctgcatattttacctctatttcatttttgaaggatatttttgctgtgtgtagaattctatgtcaacttttttttaagtttaaaggtgtttttcccttcatctcctttctgttaaaacgtcacactgactgtaagtcttaatattggtgctttgaaagttccctccccgcacccccctgtccagctgatttggtttgtattactttacggagatgttcttagctgtggactacttcatatgtatcctttttggtgctccttgaacctgtggcttgatgtttctaagtactatcacttaagacactggttctctgccattctgtctcccctgctgacgctcattggaataggttagaccttttcaccatgtcctgtacatttctcatgttctgttccgagtttttttcttgctgtaggtcactgatcctctcctttgctgtggggcacagtctgctgtttagccaacctaccaaattcttgattccattgtatttttctattctgtgatttccattcgattctttatcaattccagttctctggtgaaaattttcaccttgttatctcttttcttgtacacatcagctttcagttctagccctccttacatcaacatctttgaaatggggggtgtgtgttgccatcagtctgactgctgctgatggcctggactcagctgttgctgtcagcacagtgtggacttgagggcatgactagacagaggccagtatttgtgccgagagccacagggctcacccgtggagggaatctgagtcccgattgtggaatggtggtggcagcatcacgtcctgcaggctggagcccatgagtggtccccgagagattgcctccgagcgctgttaggagagggaagagctgcactcatgcacacagggtgaccctgggtgaaatgtaggctccatggctccgagggggaagtgggctcagaagagtgggcttctgatctgaatccaagaagggttaggaataccttagccagtttctgtggctgctttttttcttttgaaacaggctctcgctctgtcacccaggctggggtgcagtggtgcaatcacgggtcaccgcagcctcgacctcctgggctcaagtgatcctcccacctcagcctcctgagtagctgggactacaggtatgcgacaccatacctggctaatttttatttttatttatttattttttttcagttggagtttctctctgtcgccaggctggatacagtggcacgatcttggctcactgcaacctctgccacctgggtttaagcaattctcctgcctcagcctcccaagtagctgggactacgggcacgcaccagcacactcggctaatttctgtatttttagtagagatgtggtttcaccatgttggccaggctggtctcaacctcttgacctcgtgatccgccccttggtctcccaaagtgctgagatacaggcgtgagccactgcgcccggaccatctggctaatttaaaaaatttttttgtagagataaggtcttgctctgttgctcaggctggtctcaaactccagggcttaagcaatcctcctgccttggcctcccaaagtgctgggatttgagcatgaaccaccgtgcctggcctgcaggtaatattcttttgtgtatatataagaatttaaatgaggccgggcgtggtggctcatgcctgtaatcccagcactttgggaagccgaggtgggcggatcatctgaggtcaggagttcgagaccagtctggccaacgtggtgaaaccctgtctctactaaaaatgcaaaaattagctgggcatggtggtgggcgcctgtaatcccagttactcaggaggctgaggtaggagaattgcttgaacccaggagatggaggttgcagtgagccgagatcgcaccactgcactccagcctgggcggcagagcgagactgtgtctcaaaaaaaaaaaaaaaaagaatgataaatgagaaacatgtctgagtaagttgataatagctcttcttactaagtatcagataaaaattccaaagagaaagtgttgtgtcgtgtcatgtcatagtttaattggcagttttttccttagtgacatagaagacagtgatggatcgtacaacctttggcaccttagagtttatgaaaaagtagcatctgttctatagaaattatggccacactctgaggagcagagttggggacaagagtggaaggaagagtctgatggtgacacggtctcctgcaggtcttcccagagccccattcaccacccatgatcactccctgccccgtttcccattttctttatattctacccttttgcggcaagggactaacaagggccatgcatgcctggcaacacaggcggtcccatccttcgctcaagccctaagtgacccctgctggccgcactcaatggtaactgactgctggaaggatggtcagccactgtccccaatgcaggcagccccttggtccccccattcccatcgttccccaccccatctccccacccttctctcagcaggagcctcccccataccaccccaagtcagcttcctaaaatgccctgtggctctggctcacctgctggaaacaaggcaaggtcaaggtcaagctccaacccccacccccagcccagctgcccttgggggttttcctctccctctgctgcgtttccttctcttgggcctgctcatctttctcgggctctttttcttctttgtctaagtcttactgccgacctaccacacttaaggttctcttctgctgccatcttctgtcggccctggcccctgagcacgggaccaggattggaagtggcaggggttgagggagttgagttagggtgtaagcgtggctgacttggtgaaatcttaagatttgggggagatctgaagtgccttgctctcaatgtcagtattgattgtggatgggttaggaggaggagaaaaattccaagtctcagcacaaggcgggtggctgtgaggagcagatgcagttcactattgcagagtcggagccggagaggcagaggtggaggccgctgacgccaggccagctctctaggtctcagcagaggagtcgcgcgggagccccaggactcactctccttgctcctagcaggcctcaactaacaacccttctccaccacggtgttgagccgttgatgggggtgatatgagcttgtagatgagttggggagacctggtgttttgcacccgtggcagtggcacgcttcttgggctgttctgctctgctttttatgtccgccgataaggtcggagagtctctccccggcgctcctatgcacatcttgttaagtttcttcttagagcttctgttgctgctgggaaagggatcccccaccaccccccgccccctttcttagtgggttcttaggatggcgcatgagagagttgctctttattgcctcctggttctcccagtatgggtttttatccatccagtggttccaagacagtggctgtgatgaacggagttgccgcgagtctcgtggcatttggaccctgcaccgctcgagattcactgcgctgcacaccagggcctcggtaattcagtcaaaacaacagatttagaggtgtacagaaagggccattctattttccattttgtatatttcatgtctctttaaatctcttaaagcttagaacacccgtttttcatatgcctttctaaaaacttttttccaggcgatttttagatgctatttatgtgtagtaaaatgcgtagatcttgagtgtttagtctgatgagttttgacagttgtatcctcctgcttaatcacactcaaagcaagatggagatcatttccactccccagaaagctccctcagccccctttccagtcagtttctcctggccgaggccagccgccttctgcctcctatcaccagaggctagttttgcccatggaactgaacgccccgatgagttcgtcttgtctgctgcacagacaaaaccaattcacggaggctgcaatattgtagtaaagaaagaatttaactcaaagccttgcaggtggaaggacgggagttttattattactcaaatcagcccctctgagaactcagagactagggtttttatggataatttggtgggcggggctagggagtgggtgctgctgattggttggggggtgaagtcatggggtggggaaaatggtcttctgcactgagtctgcctctgggtggggccacaggatgggtccaggtggggtcagttggttgccagaacgcaaaactctgaaaaacatctccagtcttaggttttgtaatgtgttgttttctacaggagcaattggggaagtcgcaaattttataacctggccacgactcccgagcagcaaggaattatagaaaggcaagctagggatgatggctgggtatcattagtgacatctacatcttagcagaattcaggcccctcacataatcctaatctcatggcctttcatagtcttacaaaggtggtttcagtccctgaaccaggaggggaccagttttagggagggactgttatcatccttgctttaaagttcaactgcaaactaaattcctcccatggttagctgtgcctgcatccgggaatgggtgagggcagccgcctgtgaggttaggagggaggtggaatcagccttgccagccttttctccctgtcataatcttgcccaggtggcctcacttattttttacctttttctacagtgaccacatgtgatgtattcttttgctcttgcgtttggcctcgttcactcagggtgaggcttctgagactcgtccgggcggcagctcattgctgggtgtcccggagcctgcacatccacgcagggtgcatccaccctccctctcccacaggttcacgctgcacctgtttccagtgactggcttttagggataaagctgccatgagtgttggggtgcaagtcttgtgtggaccatatatttttatttctcttgagtgtatgggattgcaggtcattgggtggttgtatgtttccagttacattttgcaagccactctaaattgacaaaaatgacaaaaatcatctctttctttgcaaagccaggcaatctgcagaggaatctttatttacagtttcctccagcactctggagacatggaagcgtaggcatcagtgagctgggaggtatttggttgtctttgaatgaattattaggtgagatattgacattatttcccctcaaacagtccacattcctgaatggcagggagtgaaggcagcctgtgcttatgtttgtgcttattatggagtgtgcacgtggatctatttaccgtgtggaaaataatagaatgaattgcttttacacattactgggcttaagaaatggaaggtgacatagcctttgaaaccccctctgagcccctccccagtcacagtcccctctgtcttcctgagctcaccctgtcctgattgggccttgtgccttcctctgcttgagactggttctgtgcgtgtgcgtgtgtgcaagcaggtgtgtgcacaagatgggctggcctgccctgctttggcacggaagcatcctccgctgggtgtttgttctgaggctcatctcacaaggatctgggtcctcaggctcccactgctctgcatcttccccgtgacagccgcgtgggcatttgctcttgaccctgtggtggctgagacagaaaccttggaggagtcactcacttctgttggagcaaaatgcaggcctcctccagggctgcgtctgggagggacttgggtggtggagtgtttatgacttagcgcagagggctcttacgtgcaaaccatcttggctgtggagcgccctgttgcctggaaggtctgccttctcatgggggctgggcttccagactcctgaaatgtgctgtgaggcttcctattctttcttaatgattaaaaatacgatttcttctttaatgcccagcacaaatgcatttagctgtgtttatttttttccctaagtaacagaagcaatcctgagaaaataattcttacactcagtattgattctctgcttcatgtgctagggtgttccccctcccactgaagttgctgctgcttcaccctctcctcctcgatggcctaccatcctgcagcctcgctccctgcgcctgcccccttctccttctcctccttcccctttcagtgcttgctcttccctcctttccttcttctcttcctcaccccactcttcccccttttctcctcctgcctctctttccacctcctcctccgtccctgctggtctcctaagaagcacttagtagcactcagaatccttgaccttggcaggcttgggaagtgttggttaatgaagggatgtgaagacgaagggagtctgagtctccaaaggaatcatggctgttgggagtttgcttgattaggagatgggccgtttattacaatgtgagttgttaactctaaagtgcctgagataaatttatagtgtttatttgcttcagaaggagttggattttttcttacaaagtgaaatatacttttctaaattttatgtttatataaacataatttatgttgttatagttttaatctgcattactcctcaaaaggaacaaaaatgttttggcttttttctccctgagctgcagagacctttttctcctgcttctgtcctctgtattctccccacccctttctccctcctttcttccctctttttaatctgtcaattaaaatatttgaaaggatatcactgagatctttgggcaaggactttacctgtttttgctgttgtcaaccgagggtgcggtggctcctcccacctgctgtctctggtttttactgggcttcctctccattatcctaattaggtggtttgccggttgttacacatcaaagacctgagtttcctggcgaggagggagggaggcatgggagcccctcattaccggcgtgcatcctaaccacactgcttgttttcttcttgagaaaatttttttcttttcttttccctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttccatgtcctttcctttcctttccatgtcctttcctttccttttcctttcccctttcctttcctgacagagtctcgttctgtcacccaggctggagtgcagtggcgtgatctcggctcactgcaacctccgcctcccaggttcacgccattctcctacctcagcctcccgagtagctgggactacaggcgcccgccaccatgcccggctaatttttttgtatttttagtagagatggggtttcaccgtgttagccaggatggtctcgatctcctgacctcgtgatccgcccactttggcctcccacagctgggattacaggcgtgagccaccgcgcccggccccccaaaaatttttctttagaaatgatataaagtatgaagaactcttggaagatcttcgtcggaaagatgaaggaagtcttgtttgtctcgtaaccctggaggccactgagtatctctccctcccatctgcctgtgcccgtgtatcctgcgtctgttgtgaaatgtttaccatgccttgactgggacttgtgggctgagcagggaggacaaacgttttatttttagtgactgtccctcaaagagctatactttcgatgcctttcaatatgaaatagtaaaaatcttgccatttgatattacctaaaatattactcttctccaaagttggtttgccaaaataaattatgtttattatctactctttctccttgatattatctaaaatattattcttctccaaagttggtttgccaaaataaattacgtttattatctactctttcttcttgctatgagtttaagaagactcttgttccctctccctcgatcaagcctgctgcagacacagaagatggagactagaagaagtgctaggacaagctaccgctgtcttcagggtgaccctgaagagttaggtccttgccgtgagtataggtgaggccgaaacaagtgacccggaatctaatcacagcctgggcagagtgtaggaagggcgcaaggatgaaaatgactgcttggttggacgcagcaaaatgttgattattggccatatatgcgtcactttgctagttgctgtggatataacaataagtgatacctcctactggcaaagaattctaagtctgatagggaaaataaacatcattcattcattcattcagcaaatgtttattgggattccactgtgcttcagcctctgtgagcagcgcccaacattgcccctgctgtagtggtgcagagcctcgtggggagatgggtggccgagcagtccgagaacccacctaaggagtggatggtaaactgaggcagcgccttgaaaggaagaatgctgtctgtgaagggtgatggcgagttctcttgaccagaagccatgcgaattactgcccgtgtcctctgatcgagccttctaggccactaccgtatcctcagagaaggctttatagtccagccaacagcactccaggaattgtctactcaaggaatgcagtaggtggcacttgttgagtgcattctgtgtggttaggacactgattcatcagggcctggattttcccaataaccccgggaggaaggcgttcccgtctccacgtccctttcccagcgtgccagtgctgatggtaggttctgctggatccctgccccggtgcatgttgatctttccagtacagcttgttgccccccagggaggcagggaagtaagtccataccacattggaagagttagacgggtcttggagaggctggagggggacagccgggggaagctccatagaggtggtgacgtctgagctgggagcgaagggagaccagggctgggcaaggtgggcaaagtgtgagcagacattccagtggaagccagaggagcaggctggactctgcatttgttcctactggaataaggaacaggtgtttgagtggatacagaataaggacttgatcgccttccttgctgacaagtgcatcgtgaggtgctcttttttctactcatcccactttcgaagtttctttttcttgactattttgacttaagatgcccagagttaataaagttgcataatttatcttcccatttaaaagatgtcagtggaagtcatagcaaatagtaagcccttcgcacccatgacctttgtttagctgagtctcttgggacaaagataacaagttgttgacacacgggagagaatgttagtattctttgtggtttcatgggacaaatatggaggctccttcatttgcttgatactaactgcagtttggacttaagcctgcagaggtgattggaaagattttcagtgaaatgagtggtgtaattgtgattgtgataatgcaggtgactgcttttcattcattcggttcccaccggcagcctggcatttagaaaaaagttaacctttctgtgaaatcattttagtgggaaaatccacaagggtctgccattctgtcagcaacaaaaatgccgtgggcagaacgaccttcagatgggattctggaaccacagggggtttaatgcaaacagatgacatggaagctgcacagaggaaacgtctggtttcaggcgcgggcatctaacctgccctgttcttcagtgcaggtttcagataccacagcagtaaacagttaccacatttcccttagtgtagcaggcctgaggggtagcggagaggcaggttgggcctccactagacaaagtttatcctagtgagttcttttgggttcaacttgtcaaggagggtggctactgagaggttgcctgataatctccaagtttcttccatctccatccatttttactcattactagcctttataaagtacagagtgagataattttcatcatgttcctaggctggcaggcctgggttctaagtattacttgaggtcatagagcaggcttgtgttctttgtagaaaggcctttgataggtggccgcaggaggtcttcgcgccctgtcccctcagcatgcacttgttctcccagagtcggccatggccattcttccaggcttctggagaaaggacctcctcacaagcagacagcaaaataaaacaatgaccagtgtcagagaagatgacacccccgtctcccatgtttgcacgcctcagcagttctcagccgtatgcctatgcttttacaagtgaaaaccagctctttaggtcacttgcgtcacagggatctcctcttttctgtccagctacctggcagtcattattcctcattgtttattgttagaaaccttttgttcagcagagcggctgccccagggatcacaggcagagcgggtcctgctggagtttagtctcaggacagcggcttgtccgcattcgggtttgagcatgagaatgttgttcccatgatttcagagaagaacaactgttttaaaggtcagattttattctgtccagtattctgtaaaggacgagttgaatatcaatgaaagaaagagctttagtagctgtggcagtgctgtgggtctgctgcctcccgggtgcttctcacaccacagaggctggagagccaggtgcccctgcagccagggctttgctcggggacacgcttgccggaggccaggctaccctaagtgtgcaccgagggaggtggtgggacctgcccgttctgctggctcagcaggagcagccaggggctgggggcttctggggctttctagggcgtgggaatgtgggtagggggcatttcccagctgctgcacaggccactggtcctggcctgccttccctgaaagctgagtccaaattcttcttctcttgcccttgcacggaatctgtaagtcacagaacacccggagtgctgcccttgctgcattaatagcaccagtggtttctggggaacttccctgacctcatccctgttgcatacagtagttcattctttcttttttttgagacggagtttcactcttgtcgcccaggctggagtgcagtggcgcgatctcagctcaccgcaacctccgcctcccaggttcaagcgattctcctgcctcagcctcccgggtagctgggattacaggcgtgcgccaccatgcccggctaattttgtatttttaatagagatggggtttttccatgttggtcaggctgttcttgaactcctgacctcaggtgatccgcccgccttggcctcctgaagtgctggattacaggcgtgcgccaccgcgcccggcccagtagttcactcttaaaacgccttgttatgtttctcccctgcgctctggtgacccccagacctctccatggagggacaatcttctgcaccaggagctcttcccctctgtggatcatctctctttcctcttcccttcctttttttcctgatacttctgatacttattcaaataattcattttttttgttcttcagtcgtcactttcatgtttgatttctgaatgcctctttaggcctggcctctgtctttgctcaaattgtgtatttgagacagtctacaacatcactcaggtatctttagatttgtcttgtctgagtggaattcatcctaaaattggaagctttagatgtacaagagatctgaataatagtttaaaaccattaccctcatctgaaagataaggtggtggggctgggacagagaaagtgacttgctcagtgaaatcgactgcagaccggactccgggtttcttggtttcttgttcactgtaaggtttgaccttaagccagtttcttgtcacaactgtctcatttccgaccataatacagagaacatcacctttaaattgtccctcttttatcaccatccacttagtcaccaggtcctacccgtcccttgtccgtgtcgggaatttgcgccttccctctcctttcccactccttgttctaattctcagtctttatacttaagcctcactgtcatgccactgttgccattagattttctgcttctgacctttttaagccttttaaccatccggagcgttgctgtcagcactcgattttgacatgacgcctgcccgctgcttcgtctttttctatttgtaccctatttttttgatggcactcgctacctctcacacactgtgcagttttcgtatttattgtgtttagggtctcttccccacttgactgtgagctgtaggaggccagaaattgtaatccatttggtaacagatgtacctacagctcccggccaggtggtcatccgcagtccacacacgcattcagctctggtatacgatagatgtgtagtgtagcagcacctggcgtttgcctgtagacgacacacagtagttgttgaatttgtgggacccttgataatcagccccccaactcccccccacattcatttctgattactctgaagcataaaccctccccggtagccacaagggtctcctcggtcaggggaatggattctccctggtcctaggggagcacacgctcgtccttgttaccctctctgtggtggagctgggttgcacactggaacttatcctcgccggggtcagtgatcctggaggtcggttgcctccatattgagcccctaaagcacctggccctgggaagagcgtgggccctggagcgtggcccagtatttcctcttctgttttgctgtatcctgaatttctcttctttttctttcatttctcagagtccaagtcacatcctgcttcctctgggctcaccatctctgccgtgttgctccacgggcccctcctggcctttagtgccctctgcagcctgtgctcttcgtccttgtgctgcccggcagccgatggcctttcctccaggctcggcacagtaggaagcgccaatgttcctgataatcaaatttatgggcgtgcgtgtgagagagagagagtgtgttcctgctgaagcatctcggttaaatcaaaacactctgtaattattgggttcttctttcctcttgccagaacactctctaattattggtttctttcctcctgctcttgacatttgatgtgtctatttgccctctctgtcaatagtgctgagtagaatactgcaggcacaagtcatgtttttgtaacgattttcgacagattagcattcctttaaaaaagaacttaagtcggttggggaagggggtccactcatattacaagggggatactttcaaaaatccttcaaataatggtaagagaagcagctttgcatagttgtgagggaacctggggcttactggagaagtgagcacacttctccaggcatgccatctgcagccttccttttctttctaggctgacctatggtcttctggtcactagtcattccatttggcagtagaatcaccttctcagttttgaaataggtgtaaccagtaggggaaaaggattgtggtgtgcgtggtgttctttgcgcacaaagatgaccgtggaatttttgaaggaggcaattattgtcattgtttaatatataactggaggcttaatttccaagtagctgttgtagcattaaatgtccctggctaggtgccagtagctatttccattgtacattgaatctattgcttctttttaaaatacaatggttcgtaggttgatttatctttattttaaagaaagggctaatatcacaaggtaagtttttgagcagatactatattacgaagtgttctgactcggatactggagaggaacagtggccctggatacctcctctgtgaaggtcaggttaagatctctttatgctcacagtataaagattaggtttggctgagagttacaggggagaggaaataacaattgtgtaactcaaattaaagtttgttcactcacattaagattccctagaagtagtcattccaaggctgtttagtgctccagcatagcaaggcctcgggctcctcctatgtttactttgctgtgcaaaggttctttttttttttttttttttaaatggttacctcattgtccaagatggctgctcaagctccagccattgcatatatgaggggacttcaaaaagttcatgcaaaaaaagaattaaaagataaaaataaaaaacaaacttctcagccaggcgcggtggctcacgcctgtagtaatgccagcactttgggaggccgaggcgggcagatcacgaagtcaggagatcgagaccatcctggctaacacagtgaaaccctgtctctactaaaaacagaaaaaattagccgggtgtggtgacaggcacctgtagtcccagctactttggaggctgaggcaggagaatggcgtgaacttgggaggtgaagctttcagtgagccgagatcgcgtcactgcactccagcctgggcgacagagcgagactctgtctcaaaaaacaaacaaacagacttctcaacataaggtctaacaagatcaagacacttttgtaaatgacgataccacccatttaatctgtccctaaagaacggagggttctaggagtttaactgtgtctatacagtctttttacattattttattttttgagacagaatctcattctgtcacccaggctggagtgcagtggtgcaatcttggctcactgcaacctccacctcccgggttcaagcgagtctcatgcctcagcctcccacgtagctgggattataggcgtgtgccaccacgcttggccaatttttatatttttagtagagatgcggtttcaccatgttggccagattggtgtcaaattcctgacctcaggtgattggcctccccaaagtgctgggattataggtgtgagccgccacgcccagccctctttttacattattaacagaaggaaaaatacgtttcctgtaaagattttttaaagattaggaaacaaacaagtcagaaggagccaaatcaggactgtaaggcagatttttaatgattgtttcccatgaaaactgtcacaaagttccccttgttggatgcttgttttggatgcgagcaatgagcaggagcactgttatcactgtggaggtggagggggctccctggtgacactttcctgggcatttttctgctcaagcttaggctttctcaaacactcgtaacaagcagctgtcatcgttgtttggcctccagaaagccaacaagcaaaatgccttgagcatctcaaagagcggttgccgtgaccttcgctgtcatccagattgctcttgctttgatggagccacttcttggtagccggcgctttgattgtggtttgtcttcaggatctgctgggaaagtcgtgtttcatttcctgtttcaattcttcaaagaaatccttcagggtcttgaccccatttgtttgagatttctgtctaaagctctgctctggtctgcagctcatctgagtgcagcattggcagccatcaaatggaaagtttgctcaactgtaattattcagtcagaattgtgtaagcgcgatggagaggtctgtgatactggctgttgtttgtgttgttaattgtcagtcctcttcacttagggcatgaactagatgaagtcttgccttgcaaattggtgtggttggtctgccactgagagtgtcatcatcttggccctccttaaaattaattgtccacttgaaaactactgatttctttggtgcattgcccccatcaactttttgtaaagcaccaatgatttcaccattctcccacccaaggttcattataaacttgatgtttgttcttgcttcaattttagcggaatttgtgttgctctgataagggctcctttcaaactaatatcttatccttcttactgtctcaaactagatcctgtttacacatgttatggaacaagttagtataagtttattttggggcaaaatgttttttgaagtacgtgcatagttttttttcttgaacatgaaaaccctttgtacatttcacctttccggaaagaagaagtagggaagaagaccccactgttttcctttaaggatgtttcttaaaagttacactcagcactttcacagggaggctggaaaatatctaggtgaccctgtgtgcaaatgaagaactggggattctagttatggaagggtggggtggatactggggaaaacgaacagcctctggcataggcgccatcctggctgatgctgagtttcttcttttctacctgagcttagctaaaatctcgccaccacgcccagaagagaatgcatttgctttggagttttctgtaatccttctgaattggttctaaattggtggccggcgcctgtagtcccagctacctgggaggctgaggcaggagaatggcatgaacctgggaggcgaagctttcagtgagccgagatagcgccactgcactccagcctgggcaacagagcaagactctgtctcaaaaaaaaaaaaaaaaaaaaaaaaaaaaaaaaaaaaaacaacttctcaacataaggtctaacaagatcaagacacttttgtaaatgacaataccacccatcttgggatatgatcaaatatacactaagaatatggaaatgaatcgtcctgacgtggaggtagaatactcaggtgaccagttgcttccaactaggactcagtcacccctggcttcagaagggcaggagacacgctgtgagaagctgtgagagtgttggagatttaggatgattctcagttcgcagattctttgttcagctatgtccagtctgttttgaagcctttccattttcattttaagttgttttttttcttacaaattctgtatagttatttatttctgatttggatgtctgaagtctttttgtatctgattcagctacagtttttgttggctgttcgtcatggtgcctgtttcctaatgtccttttaaattttgacagttattttcctttgaaattgaagtatgtgaaatctttgaagcttgggatgaagttggcttcttttaggactatgaagtttgcttctatcaagtgcttacaggtcctgacagtctgaggttttctatcacacccgggtcaaggccagccatccctcctctctgtttattactaggctgaggggcagaaacttttccttgcagtgccccggtggggtgggtttactttcgggtaaaccttgctctgcgtctgcagccctctgcacacccactcttctggagggatgccctccctcagacaccatgccagcacgggccttgggcgttgcctcctgcccctcaggccgcccatgactgcaacgccccactccagttcatgggctcaggcccgcggaacccggctgctctgctcaccgggctcgggcccgcagaacccggctgctctgctcaccgggctggccccagcttcactgctctcacaccagcacatccgtgaatttcagaacgtgcccctgcctgcttgtctgccccccacctccaagcattttcacttgttagtgagaggaacctggagcctgaatccaccacattgctggacattttgtgcttgtggtctttttattaccgcagatgtgatttccttgcttgtttcttcaagagcctactcttaagaggtatgatgaaatacttttgagagtgtgaatttcactaaatcacaaaatctgaaaggtgtacaagcagacaattctgaaagaaatagaaaatgtagctgagtgtctagtatcaagtgtagccatttctggtgataaattattatacgcattaggtggatagttttgtttactaagaattgaaggtaattctggaaattgataggtcagcaagcctttgcttagtgtgaggctaaggagtttgtcgtgtttatgcaaaatggtaatgtcctactgctgctttatcgatatggaaagttccagtaggttagaagtggttaagtaaagatgaatggcgaatgggatttgattaaatgtaaaagtttctgagggaagtgaatcactgtgtagatggagtcacccccggctattgatttaaatgacagttcagaaatagtatcaaaagaaacaaaatggccagcgtgtcaagaaaccagcagctcttctgttccggggtagccagcaccaggcatcagggcccccgggacctctggacatcagcgctgtgggtcgtcttggaattgacacttgagggcagatgaggcagcaccagctcctgggtgcctctgcacccagtgccctgtctccgcagtgagtgaggctggaccgggtgtgccagcatctggaggggtctgcagggtcggaatactgcatacagttggattttgaggtggagcattagctaattaactgcaaccaaaagtaaagtagcagggtggctgcttctccaggcctggaagcctgcgtggtggctgaactgcggtccccactgcagcagaaccgggcaggcctcagtggcctcaggctctgtccctgtgtatttcatggagaacagagtcagggaggtgcagggctcatcgctagccagggcacagcgggaccaggcatcctgatttgcagcctggtggcctttacctagtgccgcctcatctgacataaagtcacccgtgtgggggagagctgtattttaataatcagtttcaggtagatcccggaaacccaaacatatagaaaggtgagggacttcggttcccacctcctgagcaggtactgcctcgtgccagtggacctgggagggcgggaaggctgctctcaggggcacgctgttgcattatgccatgttgttcttttggttgtttattgtgatgagctcttattgtgataagaaaaataatcattttctcatctttagcagtgaatatacctcttttttaactgccatgttaacgtttgcctttgacagtgtgctctgagagacacaatctatgcttcaattctatgctcttcagctgtcataactcttctccatgtctttgaagtgcagtaaagaaagtgtaacccaaaaactgaacagtaattcctaaacttggcacttgctctccactctggagacattctaggtttcatttgagagggattttggcctgcttaaagcattttaacagcttttcgttggccccagtacaaagtctaaactctttacctgggaggaaaaattgcttttgatctggtccctgctctctaccacagcctcacctcccaccttccctcccaccagactccagcctcacctcccaccagactccagcctcacctcccaccttccctctcaccagactgcagcctgactgctgacatttcagtgtgttccaccttttcaggcgtttgctgggcagttttctcttcctcaacttgttaaattctattcatgcatcgagtcttgctgttgatgtcattttctttggaaactgttcctaaatccttaatcctttctaccttacaaaagaataacaaaataaaccccaagaaagatctactcctttattctttcacaggatatgattcctactccatcattgtcttcaactgtatggtgtgttgttgcgatgatcgtggtagcaggattgatatcagtattgctcactggtctctagtcttctagaaaataagggatggggacttccaggtagctgatgaaatggttgtgtcttaggttcctgtctccaaagtatttcctccagaataatgtagaagaacaagaaggagaaaagtaaactttgtaaaagccatgtcctcagtgtgaaagacacaatatactccaacttgaaaatcgtaaaaagaggtaacacccaatccaacatggaattcctgatgttctccatctccccactaccacaaggctctgtccaccttgggttgtaggtagttgacagaaaattataggtacaagtttgcagcagaaaaagacaaaaaggaaggagaaggaccttttgacatatgggtggatggcgaaaggaagaagaatcagcaggggaaatttagtgtcctgtagacagggacaaccacaggttgggtgtggtggctcatgcctataatcccagcagtttgggaggctgaggcaggcagatggcttgagcccaggagttcgagaccagcctgggcaacatggcaaaaccctttctctacaaaaaacaaacaaatagtattgtacaaatgagtttctggtctcgttaattatactattgttatgtaagacctaatggtcgggcatgttgggttaaggccatgtgtactagctttgcaacattgctgaatatctaaaattatttcaagataaaaattaagaaaggaaagcagtggttatgcctgtttatacttgagccagagcaacgcctgactcagaatagacagtcacccattcacgttttctaacttcagattgtgcagttgtttgttggttcttgggtttttaaataatgcatgaagaaggtggaaggagcggcgccctgggattgcagtatcgtggtgttgagtcacttgcgatctttccggttcagtgactcctcagtgtgcgtggattggggccctccagagatgctctctgtctgtgtgtgtcatcgcagccctctgctgtccatgcccgacaagccagtggctttcactgctgtgtggggtgggggcgatgtttgtgtttgttttattccaacagtggcttcgtttctcttccagggcatttctctcgctcttcacaagaagtggcctctgcttcttctgattattcacactgtccattattgattactccttatcccctttctttcctctgcatgaaaggcaggtctctgccgggcgcagcggctacctgtaatcccagctactcgggaggctgaggcaggagaattgcctgaactcgggaggcggaagttgcagagaatggcctgaaccccagaggtggaggttgcagtgagccgagattgtgccactgcactccagcctgggtgacagagtgagactcccatctccaaaaacaaaaaaagaaaggcaggtcttttgtgaattgacggctaggctcacttcctggagggcagtcggctggctcaggcacagggcgggaggaaagaggcttccgcacagccacgttctcctcattcctcacctcgtagaaaagatttttggggggtggtggttaatcatgttactctaagttttcgtttcctttttactcggctcaggaatagtaagatgcctttacaggcccgtttgaatgcatttaaacttaagaatttctgtcatttttccctccctttttgtttctcttagcttattttttgagcctgcaaactttaaatttttattattctgagaatagcttatttactaacttaaatcctgttttgaaaaaggcaggttgtgaaaaagtaaaccataaatagtttatagctgtaaggagttgaagtgtcttcagaattaatatttatgtatttatttgaagctcagtttagctgttgtcattcaaagttctgcctcaagtatgcccagatcttgtcagttacacagccttcctttctctgctttctcttcttcccaattcttccagcatctcaagaggcagggttaacaattccactcccaggctgggtgaggtgtcctctccacggttccccagagcccagagaggcggagggagccccatggtccctgtcctggagaggaagacctcccccagagtccagagagagggatggagcccccatggtccctgtcctggagaggaacctccagttctcggtcagggccaagacccccaagtgggtcacagttacttgtttttcctcttgccctcctcagcctgctggctcttctgtgcaggacctcagactgccaggctcctgctctcttcctccaggcacatcttctcaccagaactccagccctgcacctcagactccctgttcattgtctcacctcagccccatctcaagtctagaaccccctttctttcttgttgacttattccgttctaactggaatcctagaagagaatgacaggatgatggtgctgtgcctctgaagggggtttgttaaaatactcagaatcagcagggcacggtggctcaagcctgtaatcccagcactttgggaggcccaggtaggtggatcatgaggccaggagttcaagaccagcctggccaagatggtgaaatcccatctttactaaaaatacaaaattagctgggcgcagtggcaggtgcctgtaattccagctactcaggagaggcaggagaatcgcttgaacccaggtggcagaggttgcagtgagccaagattgagccactgcacttcagcctgggcaacagagtgagactctgtctcaaaaaacaaacaaacagacaaaaactcagaaccatgcctagaaaatactcagggctccctgtttgttagataaattgttagatcagccaatgagtgacatattgcatcttgtatgctgcatcccaggggatttagttagtgacagaggagaaatacagctcctttgcaagtggtcctgcgtgccgaggcaaagatccgcgtataaaatcccacgtcgcacgtatgtgctgggctcgtctgtgaacaggttacatggaccctctctagacccagcagatgggctttgaaatgtggccttcgtgttcagctggcatttggttttcaccaggagacaacagcaaacacacaggcggaagaggagagggagcccgtgaggctcattgtcaatacaggggagacagccactcaggacggggcttcaaggcatgcatgggtttgacagaggtgaggggcctggcgcactggagtccaggctcatggagggaggggttggtttggcatcttctctttagcacctgccacgtgttctgcggaggccagttagtgtcagtcagcaaaacaccacctccaaatgctggcagtggagtgtctcgctttatttttttattcagatcgataactcctaggaaaagagcatcttttagagtcacctgaaactaaataaagagcagagtgcctgagttgtggaaacactggtgctgtctgggcctcatggcagaaagttgcggggccgcggctctcgttccgtcctcacactgccctgctagagtgcgtgcgtgctgtgtgcattcctcatgccgctgctgtccctggcaggtgacagttcaggggcacctcgcgctgtgggtgagttctcgagtgctgcggggagtgtagggaaggccggtggtgcggtatcgaggaccaattctgtgtgtgtggttcaacatttctagttctcttacaccttcatgaggtgtacgtctcttacaccttcatgaggtgtacgtctcttacaccttcatgaggtgtacgtctcttacaccttcatgaggtgtacgtctcttacagcttcatgaggtgtacgtctcttacaccttcatgaggtgtacgtctcttacaccttcatgaggtgtacgtctcttacaccttcatgaggtgtacgtctcttacaccttcatgaggtgtacgtctcttacaccttcttgaggttgaatttcatttgattcttaaatatttggctgaaaaattagataataaacgtagttacaatctctcctgtcatgaacactgaggaagaatgaatttgtctaaatattctctcggtgtattagaatattggtaaatgatgtggaatcttcctgtatttgatgtgatataatcttatcagttctttaaaatgatgtagcaggctgaccgttggccccccaaaagattagccacatcatattttctggaacctgtgaatattacctcatgtggtgaaagatgtgattaggtccccccccccaccccaaacaaagtctcgctctgtcatccaggctggagtacagtggtgcaatcatgggtcgctgcagcctcgacctcttgggctcaagccatcctcccacctcagcctcccaagtatctagaactacagacctgcgccaccacacccagctaattgttaaatttttttgtaaagtcaggggtctccctatgtaactcaggctggtcttgaactcctggactcaagccatttgcctgcctcagccccaaagtgctggattacaggtgtgagccactgcacccagccaggttaaggttgttgagagggagagcttatcttggattatttgagtgagccctagatgtaatcacgggtgtccttatgagtgagaagcagaggagctttgagtcagacagaagagaaggccatgtgaagactgaggcagagctgggagtgatgtggccacaggccaaggaacaccgaggcgtgcccacggccaccagaaactggaagaggccggaatggatttgccccagggcctccagagggagcgtggccctgctgacttagtgattttgcatgaatacttgagtctatagagtttgagaacaaggactttctcttacataaccacagtacatttatcaaaattaggaaatataacattgattcagtcctgtgttctaatttgtttcctttttttttcttaaaaaaaagaaaaatagcgtcttgctgtgttccccaggctggagtgcagtggtgtgatccatcatagctcactgcagccttgaactcctgggctcaagtgattctcctgcctcagcctcctgagtagctgggaccacaggcacgtaccactacacccagctaatttatttattttttgtagagatggggtttcaacatgttgtccaggccggtcttgagctcctgggaaccaagccatcctcctgccttggcctcctagactgctgggattacaggcgcgagccaagcgctcagctgatcgaattcatttcttagccagttgtttcagctccgtctgtggcagcctccgcactggcctgggagcggaccccggactacacacggctttttgatggcacttcatcctcctcagctttgctttctcagtctggccatttttgaaggatgcgggccagttcagttctaatcctcagtttgcgttttcctcctgtcttctcccgacaagagcagggcaagcatctgtggcaggagggctgcagaagtgatactggggcttcctcaggtgctgtcggaggtgctgatggcattttgtcccatgattggccatactcattttgaccttgattaagatggcgtccccacatttctccgctgcggagttgttttccctttgtaagtaataaggactctggctctgtgcctaccctgttccttgtgctggttttgcaaccatggataattcttgcccacatcagttatgatcgtgatggttgccaaatgctggttttctgattgtatgtttttcttcccttcgcccccattcattccttcattcattcctttatatcattctaaaataaattcttattttatcccatcaatcatctgctactgtcattgtttattttgatgctccagttgtccctgatttcgctgccaccctccaagctcactcctgtccatgtgttttatgtgttctcttcactgttgagcaattccttgctttcaggcacgacaaggtggagcagcctcatattctacccgcatggctcaagtcctggcatcagccacgtttccaaggagccctggttccttttctacagaatgggacttagaagccaagatgtcggctcctggcattgactccctcatcctcaacatgccgctcagttgcctggtgccacaatacacaggaagtaaattcagaattgccgtctcgtaccatcgtaaacaaactttctcacgtgaattcactatctgttcccagttattttctgcctgtggactgaggggtggagtcaggtgtagatgccatggtcagagttacttgggtgggctttgtcccctctgttccgggctgttatttgcactgtactcaagttcacgtgtttagtttgtattctgttccgttgcagggctctcttatccttgcttatttcttcttttatgagtatgtaagttattaatgtggttctgcaagtcaaaactgtataaagctagagtcatgtcatctccccaatcctgtttccaggctgccttgtgtttcattactttcaggcatatcttgtctttcttttttttttaaataaggagatacatgtttatttatttatttatttatttatttatttatttatttatttatttaatttttctggaggcatagtctcgctctgccgcccaggctggagttgcagtggtgtgatctcggctcactgcaagctcctcctcccgggttcacgccattctcctgcctcagcctcccgagtagctgggactacagacgcccaccaccacacccggctaattttttgtattttttagtagagatggggtttcaccgtgttagccaggatggtctcgatctcctgacctcgtgatccacccacctcggcctcccatagtgctgggattacaggcgtgagccactgcgcccagccatgttattttcttatatcctgctcttacatggcaagatagtatactaggtatgctcctctgcactctgctttttgccactacacagcgtgtcctggaaatcactccatgtcagtttctagggactttctcttccttttttgagagctgtatggcacttcattacgtgagtcaacatcttaacattgtaacattttgcaattacagataataccgcattgtataaccttgttcagatgtattttgtattaaggctgtatcttcaaggtaaatttatagtatcactgggtggaaaaatgtgtatgtagtttttttctagttattgtcaaattcccttcctacctcaggattgtatacccttttccattcccctcggcaacataggagagcgcctcattcggagtcgcccctcattcagggtcgcacctcattcggagtcacccctcattcagggtcgcttgttgcgttttcagtgtatgccagtgtgtgcagtctgggagatgagaaatgctctcggtgtagttttaatttgaattatttttattgtaagtgagttgaggtattgctctgtctcccaggctggagtgcagtggtgtgatcttggctcactacagcctcgacctcctgggttcaagtgaccctcccacctcagcctcctgagtagctgggactacggccgtgtaccaccatgcccagctaattaaaacatttttttttttaatgtaggaatagagtcttgatatgttaacttgaactcctggggtcaagtgatcctccatccttggcctcccaaagtgctgggattacaggtatgacccactgtgcctggctaatatttttgtatattcagggccatttccatatatatatatatatatatatatattttttttttttttttttttttttttttttgctgtgaattatctgacatgtcttttgccatttgcctcatggaatgatttatatttccacgacttttaattcctagtgacagctgctactccccacatcgtggggtgcttcctttgagcttcttcccagctgcctctggctgttgaactccctctagtcgtaagcgtaagatggacccccagagtcgtcctgggagcagcactcggaaatgcccgacaagaaccctatttctcctcatcaggtgggggcactttccagtcctcagagctcttctgacagtgttggtggcctctgcagagggcagggtcatcctgtgcctggagggacataagcatggttagaggctttctagaagggattcaggcctccgacccatctggtgctgttcatttttgagattacgtgtctctaagataaaggattgggaggatgggccatggtttatagagcactggtcactgagtcttcctgtgcccagatgtggggctcagcacttgctatgcataaactcacctgagcttcataacaactttttttttttttttttgagacagagtctcgctctgtcgcccatgctggagtgcggtggcacgatctcggctcactgcaagctccgcctcctgggttcacgccattctcctgcctcagcctcctgagtagctgggactacaggcgcccgccaccacgcctggctaatttttttatttttagtagagacggggtttcaccgtgttagccaggatgcataacacctcctttgaagtagacgcaaccattgttcccagttcacagattagaaaactgagacttaagtgcgtcactgtctagtgcagttctaccctcacgacaaagccatgtttcttccccgtgaatgaagagaaaggtaaatttacagtatttgcctttcgggactcattggtattctctcttgaaacacttcttactgcataattcagagttctcggcagcgtatccatctcttagaaagggctcttcctgggaaggctggaaagaaaggctctcttctaacgaggccggtgtctcaagcactccactaaatatgaagaggtacttgcttgatttttacaaaatcagctttgtgagaggatgagtggtccagcccctcgcccagctgtgtgagtcctgagcacctgcgcttcagagtaaggctgttggacctgggacccttccatgaaatttattttcaatcttgaatgagatttactttaatgggaggccttaaaagcagatgccatgcgagttaaaatcacacagcttattgcatctatcagttccagtcagagctgatggcaaactcttgttctttcagttcagtaaccagagagtggaatctgtctgtctgtgtcttccataaccaaaatacatcaccccacgcaatgcctcctaataactggggctttgtggtcagggtttttgcagggcaggccccttttctgcaggcaaagtgctaatggccagcgcctacactgcaggcctctggcgcattctctgccgagagttctgtccgtcccacttctcctcactgtctagtcttcttctgaccctcccagcctggttcacgtttgctcttcgttaccctcttcctgtttctttctcctgtctctcctcccaccacaccatccctcacatgcaccatggggtgctccttcagattgtcatctgatcgagccacagtcccactcagcccatgtttgtcaggactctgccactggtcacttgtccacaaggaaccactgtctttgagcttcttcctccggtgctcttagcatctgcccacactgtatctatctgtgtccaggtcttgttttctgtgtcattgtttgatgaaaggcagggactcattcggtgagtgggtctcccctgcctctgccccacaccagcacactgctctgcccttggtgggcacccgttggtgtgtgttgagctgggtgttgtacctcggtgtctgcgtggagaaatgcgaacagtgagtgccacagcacagccacggaatggttgtcatcggcttcagaaggggaatgaaaggggcagcaccgtgggtgttgatgatctccgaggctgcctgtttagagcgtcccttccctgagatggaggcgtagcttcaccgtgtagtgtttaagctttaaaacgtgaaatgcagtgaggccgacagtgagttgtaggaagctcagaaatgggatgcccgcactgccttcaattcaccctccattgtccatcgccgctggcatacccaggtcagcgcctgcaggcccctgtctcaaaagatgtggccggcttcttgtcccggtactgcctgaagcttcacctcagcaccgctagcttcacactggccacacccacctccactcagcagtctccatgctgtagcccaaagcatgtagtggcggttgagtacctgagtgggggaaataattaactgggatgcttttattgataagtagtcagatgcctgttaagtgacatttatgaacactcacgtagcactgctgcctgttagccaggcactagtcaaaggacttttgatgtattagctcatttaatcttcacagaaactagaagttagacactatcctctccactcccttcacccccagccccaaacacacacaattttatagccgaagaaacggaggcacaaagaaggtgaagactttgctaaagtcacaaaactggtataagcatgggctttgtgtgtgtccaaagttcatccctcaaccgtttctctctggatcaataattaaaaggtttatcaagaagtctgaaggtaaatggttcagtattgtcaggttctggataagtttctctgtgttcttgacttttccctcatgatgacaagaaggctgccaccactccaaacatcacagcctcacagttgtgctcaaagggagaaagaagaagggacggccgttctcctttgagcacactgtttcactggcttcctgtgggttccactggcctgacttgatgcctgggacactttaagcatctccggtgctatgcgggctgggaagaagtgagctgtagaggcagccagtgttactctctgctccatcccttttttgttaattttgcggttactgttatttaaactagatgtatctctagggcagtggcaggaatcgactccaaggacactgaccagcttggggctgctgcctggcccaggccggcgcatgttggaacacagactctctgcccttccaccccaagcctggtgggcgagtgagtctgcccagagggagtgcctttttctgctttacacaaggcacctcaaggggtagaggtggcctctcctgcagaacggcagctgccctgttgccgttctgataaattgcaagataaaactgaagtgcaaggaaggggcatttttgattttggatatgactttgcctaaaaatggcaccttaaggtgttttaaacatttatcaaacggtttcatatgtatggagtatgtctgtgcagcattcttaaagtgacaggactaccttatgaagtcagtaaatcctttcatctccccagacagccagaagctagtcagcagatgaacacattcacttgtatgttccccttggcaacattattcctagagaggttgcatctgcatcttggagtccgcatgataaatcatttatgtactcacagaaaccatgcactcccccgtgggaagagttctaggtgtagcaggggcggaggacgccacctgctccctgacatccgtctttccgaagccatcgctggagccctctgctgagtgtgggcagtgaggcctcgtcttacgcatgtggtcagaggagataatgtggctagaagtgctttgtaagcgccaaggattgctgttatgaggaatttactagatttcaggctttcatcagatagttagcgaggaagcgcaaaagcacagcatggtctccatgtttgctgacctgcagcgaaaagtcagaaagctaattggaggccattcataggctgattctaccttacaccatcattatactttttgtctataagactggagaagatctttctgagacatatcactatcagtgttttacgcgtatgaaacatatttttctttccttctttatgttcatttttaaaatttttgatcagtgccctcaagcattctcctattcaatagaaaacatatttttctaggtatgataatctttcagatttttggtatgtgtacctttgctaaaaacacatttaatatttctacctgtctggacaccttttaaaaatgtctggctgcaccttggagaaacgcttcatgcaagcagattctaattaaagtaggaaactttactttaccattaagttatatgtaaaagcattctaggggagagtcttttaatcattgaaacattttcaaacgtgtttgctcatttgcttctttatttgtttttatggcttattcatttgtttatttttaaactttttattatgaaaaatttcaacatatacccatcatctatcttcagtcattttcagctgccagttccagtctcctttcatctgtgcccccacccagtccccccttcccactcccctggctgattaggaagcaaatcccagacttcatgtaatttcacctgtcaatatttctgaaagaaatatttactttctctaaagataagtatgcttctaaacacacacacacacatacacacacacacaatgtttgtttgaatcaggatgcaagtgagatgaatgtattgtgagttacttcatctattctgttaatccatgtaattaatccaaaagtcagtccctcaccccagcactctctgtgcacctgtctgcctgtctctttctgcagttgattggttgaagaaactggatcatgtagcctgtagaatttatcgtggtctcgatctcgtcagtggcttctccccccttgccctgggtgagccacactcacctctgctccttggatttcctctcggtggtggacacagccgggctcccctagattctggttcagtcagggaatgtttcatgtgtggtgctgtgtccttactttaggatatctgatagtccctctgtgatattagcagctattgatgatcattgtctggatctatttattagagattatgaaaagatggtgttattgtttcattcctttttttgcaacaggggatctcacttggccacccaggctggagtgcagtggcgcaaacatggctcactggagcctcaaattctcgggcccaagtgatcctcccacctgagacttccaagtagctgggaccacaggcacatgacactatgccttgctaatttttaaatgtcttgtagaaacagggttttgctatgttgcccagactggtttttaattcctggcctcaagcaatcttcctgcctcagcttcccaaagtgctggggttacagatacgagccactgtgcttagctgtccttatttgttaactggagtatctctatataaagaaaccctctcatcaattatttggatagctcaaggtacagtcatagaggaaagccagcatcaatacttactttcctttattaaccagttttcaaaatcgtgtgtgggcttctctcaaaggtgactagtaaggggtgtgtgggtgtgatatgtgtgtgtgcatgtcgtgtgtgtgtgcatgcacgtgtgtgcatgcataggtatgtgtgtggtgtggtgtgtgtggccaccctgttgaaggcactacctactgtattcgtttctcactgcatctctcaaaggtgactagtgtgggggtgtgtgtggatgtgagtgatgtgtgtgtgtgcacgcatgtcagtgtgtgcgcataggtgtgtgtggtgtggcgtgtgtggccaccctattgaatgcatgacttactctattcgttcttcaccgatgtccacgtcgttccatctttgtgttggcccctgagccttgtgatgcagttctcgcggtcctcaattgcttcattttgatatggtatgacaagccagcatgttctgtgccattttgtacttcttctaccctaggcctgaaatcagccacgtgtctgtctccagggagtcttggtttccttccatgggaagtggtatggagagcttaatctgggctccagggctgctcattgacccttgttcagccccctttctctatgggtgtttcaaagataaaatacgaaggcgctcttacacatccaggttcaggtctgcaaggtctgcttactctcatgggtcctacagctgtatctgcttctttccacatggagtgctcagattgttcatgaacaccaacgtaattacccattctcttatcctgcaccacacctggcagtttcagaaagcaacaccagcactgccactgacgcggttactgagagccgctgccgaggcatagccgctgctgaggcactcgcccttccttctcaggttaggcacagatgtcgagtgacattaccctgtatttttatttatttatttttgagacaggctctcactgtggcccaggctggagtacagtagcagaatcatagttcactgcagcctcaacctcctgggctcaagccatcctcccacctcagcctctcaagtagccaagactataggtgcacgccaccatgtctggctacgttatgttatgttatgttatgttatgttatgttatgttatgttatgttatgttatttttttgagatggagtcttactctgttatccaggctggagcgcagtggcatgatctcggctcaccgcaacctccacctcccaggttcaagcgattctcctgcctcagcctcccaagtagctgggattacaggcacatgccaccatgcccagctaattttgtattttcagtagagatggggtttctccatgttggtcaggctggtcttgaactcctgacctcaggtgatccacctgccttggcctcccaaagtgctaggattacaggcgtgagccaccgtgcctggcctaatttatttatttatatttttagtagtgatgaagtcttcctatgttgcccaggctggtcttgaactcctggcctcaagtgatcctcctgcctcagcctcccaaagtgttaggattataggcatgagccactgtgcctggctggattactttttaaaaaaattaattttgctttgtagttatgtaaaatatttcatgagtccaaagttaaatacacaaaatgaagtttattgaaaggagcctggctgctcttcctgtcctggtgagcctattttatcttttcttctgtaggtcaccactgaaatgttttaataatatgtgtaccacatgtgatgacacgtatgcgtaaccttgggtacatttatatacgcacacacgcacacagtgttttctctttagggaagtgctgtatgttgtacatggtttcttctaccttgcttcttgttgctgtattagactggaatccacgtgtcctcattggaatcaaagcttcattgtttcctctaaagcagagtttctccagcttggcccgattggcatttggatcagctaattcatgattgtggtggtcgtgtgctcatgtgctgtgcggacagtcacaggatgtgtagcaggtccccaggccattgccatcagatgccagcagggcccacttctcccagcagtgccgaccgagcctgtctgcagacaacaccagtgcccccgagggcagagttgctcccagcggagatggtgtttctcgggttcattggggggattctgagcacccatttcagaagtggatttggccccatctggaagcaatagcttttctttttggactttgaataataaaccagctattctagttcttgtctgcctcttctgcaaattaaggaaggaaggaagaattgttactgaataatacataaaggaaagagtcgatgattttacaaatttcacgtaactctgcccttactgggcagacacgtgttgagaacattacgagttactgtgaccttgtagtccctttgggttcggtgtacgcaatttcctactctcagcatctgccagcccagactctggcagacttatgccagccctgggtgctgtagggtcagccacccccttccacgcagggtgggcgtccagatggtgctgtgggaaacagcgttttgccaggggccagagagctgactcagatagtgacctggaaaacagactgtggatcaggtgggcacgggcctggaacagggtccctgaaacacccagcaagaggctggggaatgtctggagagcccggcatggtccggagcgtccacgcagccagcagctcacatcctcttgctcctggcggccgatgctctgcgcagaaacgggcttggtctgaacggagagggacattgtgaacttgaaatgaaatctgacaagaaattagaaatttcttcagaaagtaaagagcgctgtcaagaatgcgagctgaagatttgcgtttacagctgtagagcaaatacaggcggctctgacatctcagcttttgtttgccactgctgcagcctcaggtgcctcatctggggcttcattcagagtgggtggggaggcgacaggtcgaggcagttgccccgtgctcacgaatccctgacacagctggtgacctctccaggtgacctcttcaagcctggtcccaggggcaggcatgcccgggcatggccctcgcagatggctttgctggcctggtctggcaaccgttgaataaatactgatttcccacccaggtgaggcgcatggtagatgtttgttctgtgcattgcgttggtcggcctccacagtcgcacaatctctcagtggagtgagagtgtcttccatatgtggggccgtggtgctgaaggcttgtgcgttgagtgcctcctttcccgtgaatgtgttggttctggtgaccagggtggagcctccctgcgccccttccttccatccagcatcaggttcccagttctctgcctgccaggcaggcgtgcacatatggagtgtctgggaacctgcagctgttgatcacggctggtggtagctccgcacttaagtaaggaggagtgattttcccgaggagatgtggtattggtcggagttgctgggaaatcagcagcactgagtgatcaggttgtcgtgagctcctgcctccatccaccccattctggcggttcctggcttcactgcctcttgaagacagcctctctggcactcatgggcatgttggccttctcgaggggaaggggttgagtaactcatggcctgttagtgtgtgccagagactcagcaccacgggcagacacagtgccacgggcagctatatccaaggagggtgagggtgctccccagaagcctctgggcctccgtgggtgtcatcagggtagtgagcaggaagcctgggggctgagctgggctgcctggctttgacatgggcctgtgcggggctggctgtgtggccccgtgagggttactgaacctctctgtgcccagcctcctgtttgtgaggcaggagcgatggcagtgcccactgcatggtggtaagagtgaggcgggtagaatgcatgtgcccaagacagaggctgccccgacccgtgctgtgcgggtcactcacccccacattgtctgccacgggggcccgagcatttccacacgagactttcacatcagccacccgggcagggcccgcgttagtttagttgtttgtggaggagaaaattgaggtttggttttgttcatgacgttgccaggtcgaatggctggtgaatcattgatttggggctgagacttaagtttcccatctctgggcgggacctgtgctctctccctgtaacagtggcctctgttacagaggggcaggtgggtggctcacgtgtgggctcacctgcgtcacttctctccagctcacctccactgcgagagtgcctggggatgcctgccagccacccagagccagcgtcttcccaagcagctgttttacaggaaacaaagcaggatgaccttgggcttcctagtctctgcacgttaccccgaattccagaataatcgtgagaaggagccagtggagtggtgtgacttttgtatttatagacttcttccaaaggtcacctcttttatttctgaaaaacaagtcgcttgaggcccatctttacagagtgacaggagctcaggatgcagaggcaccaaggccagggaggagcgttgggggtggctggagctggtgggccaagggccgcagaccacttttgccctgcatggcctcgtggctgccttttctacctgcgtgagctggctttgatctaccccggacccatctttctgtgaagagtttgcagaggatgctggttacatcttagatggaaattggccgtgtctctgctgtttctgagtgtgcgactctcagagccaaggtggcatctggcgactggccttgttcttgtgagtccctgtagggcaggatagatttttccggcagggctgcagcctggagttcaggcttcctctcccttttaaatttcaaagactcagggttccatttaaacagacaagataagtggcagctttgttttgttttgttttttcattaagagattttggagggggaggaaaccagccttacagtgatagcatcaggaaaagattacacagaatggcatcttattatgaaatattgaaaacatttaaagagcaaataaaatatgcaaatagagtgggacagaatttgtactgcacagcctcttgccctacatctttcccaataaaaatttaactctgaggtccatgttgggacaaaaaaaatgatactgggatagtggagctcggctttcgttagttcaaagcgagcagcatattaatccaagtaagcagaattcccatgtagattcattccacagccttttcttgggtgacgactctgtgcccagaagcaaggggctgactgggacctgagaggcctcttcttagtggccatggcctcccggggcaaggccggctggtgcgtcagagcctggatctctgcagtgggcgcagaagggacacaggaattttctcttggcctctttgctggacttgcagcagggatgccgccgaactcagccgtttgcaggcgggagcacgtgagtgagcgagtgtgggatccagccagcccccccaagcaccaatacaggagcaaactccatgcggggcccacagccagaccaggtgtgtcaccttgaggggaacacggtggcacccaggcaagggtgcccatgaccctgaagccccagagtgggtgttagtgtgctcattagctcttttagttcttccatccacagtccaacagatggtggcatgttagcagctccgtcgccccctggccccatcacgtagggtggctgccctctgccagcaggagcaaagggctagtgtgacagtctttctggtaccagcacttggtgggtcctgagctcttgtccagcatccaagcagaatgcagatgtgcctacagtcagagagtgagcaaggtgaggggttttactgagtgatgaaagagctttctgcagagaggggacatgggggcggtccccccacccgaaggtgggaaaatccctccagtgtgtcttagtctggggcttttgtgggctcagaataggggaggggcaggctgtaggtagtattggaaaaggcaacatttgattggttaaaaggcattattcagaaagaatcaattgggaaagggtgggcaaacgggaataggagttttgctctgggtcttgggttttatccaggacctgccgtctggtctttcagccttcaggctgttatttggcttggaggtaggtttcaccagggacctgcccctgtctgcctaggcatttgactacctcccatcggtatcagaagcaccttgtgagccccagggagctggtgaggaccttgtaagggaggaggagggcggcgtgataggtgcaggtggcggcgtgataggtgcaggtggcaccgtgcacagccacgtcagggacttgggaacgtctgggccaaggagccaccttgtgcagaggcatggagtcatgagagattagccacggtgggaacgtggtgaggacactgggctgagcagagggctcgcaggtggtgctgggcagggagcctgttgacccacccacagagggtttgtctcaggggccggtggcctgactgctgtgcgttaaggaggaaggctctgacagaatggggggacttggagaggggtcattttggaggcctgaaggtggttggggtgtttgactcccatgaaggcagaggtggtacagcgaagtcagagggacacattcctgtgacccactgggcaccagggagatggcaggagcaggagctgagggtagtggtgaggtttctgctggcagagtttggtggttgagtttctgctggctgatttggtggggccagcgagtagacaaggatcccagacgggtgggtgcggggcaaggtggggaatttgaccagatttctcttgaaggtgccctatggggaaacggtgttgtgaaagtaggagggtgaggaacggaggcgactgagggtccacagaggaggatgggccagaggcagaggtgacaggccaggtaggccgagtgagcaggggagccacgtgaggccagtgcgggcgcaccaggcactgggccccatgcagaggggctgccgccccacccccacccaggcctcactgactcctgtgggagccatctaggtacagcaaccacgtggaggatagcgtgaaaagtgacgggacggagcaaagaaagacaccagctcctcgtttgcagaggtttctgcaccgttgtcaccagcatgtggtcatggcctgctccccgggggccattccagccattgatccacattgtcctccagccaaaggaaacaaagcgggaagtggaaagagctggagttacgtgggggcaccttccatcctaggccggcagctggtcaacctcctcagcctcgtcaccgtttaacatcctcccttttgttcttttctccttaatctttatgtttggaaagatttctatagacaaatgtgccgctgcttctccatagccttatctggaacaaaggaaatgtcttttattaccattcatgcaggtataatccgtgaaagacaagcctgttctgccagtcaccaagtcagtccttttccttctgtcttgctcatggaaggctgtcccggccctcacctgactagtggtgcagctcttcagggggtagtgcccatccaattcctggggaaacccaggcgagcctgctggccaggaagcgccagcttgtgtctgattgctaggttaccctgggtgcttcctggatgttcaggcgcccgtgattcccccagcatctgcctcgagcttatgtgcatggagcagcagatccctttgtctgggcagttagattgtctgctaaggaaagtgggtgttggagcaaaagccttgcttcactgctgtactccaacccatcaaaatggaattgtttaaaatgccctcaaaataaaaatagagaccccaagctcttgataaaacagctttctctggagaagctcatcgggctgtgtaaactccaataggaagtatttattcatcatttgtatgtgcacaaatatttatttaatgtcaactgtgaaggctgatgagtaaatcagcaggtagagtccagtaccctggtgcagtgatggggagctagaggtgctgtgcacagtaccctggtgcagtgatggggagctagaggtgctatgcacagtaccctggtgcagtgatggggagctagaggtgctatgcacagtgccctggtgcagtgatggggagcaagaggtgctatgcacggtaccctggtgcagtgatggggagctagaggtgctgtgcacggtaccctggtgcagtgatggggagctagaggtgctgtgcacggtgccctggtgcagtgatggggagctagaggtgctgtgcacagtaccctggtgcagtgatggggagctagaggtgctgtgcacggtaccctggtgcagtgatggggagctagaggtgctgtgcacggtgccctggtgcagtgatggggagctagaggtgctgtgcacggtgccctggtgcagtgatggggagctagaggtgctgtgcacggtgccctggtgcagtgatggggagcaagaggtgctgtgcacggtaccctggtgcagtgatggggagctagaggtgctgtgcacggtaccctggtacagtgatggggagctagaggtgctacgcacagtaccctggtgcagtgatggggagctagaggtgctatgcagcctttggcatggcttcctatccagtgtctggaagagcatccaagaaggatgctttcaacatgataaaagacaagggacatttaacatgatacttgaagaatgaatagaaaatgaccaggcaagacttggaataggacatggagaaaaggtaggaagaaggttctgggcagaaggctggaaagtaggttagaacataatgaggcaaaaggcttaaaagatcctttcttgtggctgaagtgtagactctcagagattatgtctagtgatcaggctggagatcttgcagggactcgtaggtctttctaaagagttttcaaagttagtgggaagacatcaaaggtttctaagcgggagaaggacctattgagttttggagaatggatttggagtgaaacaaggctggaggataagttgggaagttactccaatgatctaagaaatagataagtggtggtggtgatggtggtagtggtggtgatggtggtggtggtgatggtgatggtggtggttatgatggtggtggtggtgatggtggtggtggtggtggtggtgatgatggtggtggtgatggtagagatgatggtgatggtgatggtggtggtggtggtggtgatgatgatggtggtggtgatggtagagatgatggtgatggtgatgatggaagtggtggtgatggtgatgatggtgatggtggtggtggtggcggcgatgatggtggtggtgatggtagagatgatggtgatggtgatgatggaggtggtggtgatggtgatggtggtggtgatggtggtggtggtggtggtgatgatggtggtggtggtggtggtgatgatggtgatggtgatggtagagatgatgatggtggtggtggtgatgatgatggtggtgatggtgatggtggtggtggtggtgatggtagagatgatggtggtggtagtggtggtttggtagtggcttgacctgggtattgatagcacggatagaaagaggtggatggactcagtcaggattgaagaggtagactcaacaggatgcaatgattgatgacataaaaatggaaagggtgaaagacaagaaggtgtcaagggtgattcttgggtttctgttgtccagctgggtgattctcaggtttctgttgtccaaatggttagtgaccccatccatatggattgaggagagaggggagcaagcttaggagggaagacacagaagatgtgcactggacaattcctctctgctgaaaggcctcagacacactgatggattgcttcacatctgggaacaaatgctgtgaagtctctgtgtcctcagcggctccacctggttgcactagggtggaatcatgggaaagggcacaggttatatattcttgccatttattctcacggagaccataatgctcattccatatcaaccgaaaggtagcatttgccatcactctttttggcttttgttttgtttctctgtattttacttgtttttcatcctaacacccttaagggtgagggtaaacaagggctataggaggcgaggccttccagggaaatgccgggcagggaagaaggtcaggtccgcctaaaggtccctcctaccaacatttccctggaaatctttgcatcctacttgagaaggagaggggtagggtgaaactttcactagaccccagatggggccagaactggcctgagtcctgaaatgacatttgttcctccaggacagttctgagagtgttgcaggcatttcggtttgttggatctaaacttgacctgctattcattgctataggatgggaggatggcagcgatatcacttgtactcacagacccagcctagtacgacgccagtgtctttgttagaaactctacagatgtctatgtccagcctgccccagcggcacagggctacccctggtgggattttgtcaaaggggaagacccaccaagtagagcccctgagcccctcctcttcccaggtggccgtctctccttgatccacaccagcggcagtttgtgcagcttcaccagagcttctagcgggaccatgccgccacgagggccactgggagcagagtccctcccatgctcagggctctccagggtctgaagtctgcacttgtatgagaaggagctccaataccaataaaagtctacgtggaaaatgcagaatctgattgcagtagcatttcttaggccttattagcatataaatttaccaggtgtcattttaggacaagagcccgtcactgagaaggaaatgaaatttggagctgcattttccttcattaaaccaagggcccatttttgttttgttttgttttttgttttgttttcttttcttcggttattcattcttttattatcttctgctgtcacatcctccaaaactcctgtgcatatattttcttgcaccttgagatttggcatttcaggaaaaatgcctagcacaataggctgtagtttagagacttgctttgtcattttatatgtccagcagaaattgtcgtaactcccccggatgatcagatgctcccgtgcctctcctgtctctcagaccacacagctattatccctggcattctagttgtgagacaaaaccttaacacaatgtggtgacatttaatttagtgtttctcatttcaaagcccttaaaaatattaattaattcccatgaagccccaggaggcgtattattaatatctgtggcgcctttcatgctagtccattaatgtgccttctctacgcaataggtaagaaaatgaagctaaatccgtttttcgcagccccatgggataagaccttcacagagccagggtcagaaatgatgaatccttaattttattggtgtccctgaataatctaccccgtggccttctgtgtggcgtggaagaacagcactcctgttcaggagcaatctcaggagacagcgaatgattttcctgtggagctgtgacttcagcaatcctagttcgatagctgtgttgaggagagtagaattgagaaaaactgccgcagcagtaatgtaataagtgagatggagcaggaggcacttgacaatttcactagaaaatctcccagcgatctgtgggccctgcagtgaacccagcccctgcagatcgatgggcccgtgctccagggagacagatgtggagatcagcaccgtggcttgttcttattttggggtgccttatctttccgtgcctttgttcttcaccactatgcatgggggatttctgtagccttagcaaccagaaagcagggtggatctgtggaattagactccgaaatctcgagtttagttgacagcgctttttccttccttctgattgcctcgccgtctggcaagctctgcatgtgttcttttctcacctgtatctgcagcccatgactccggaagtctttctgactctgaaaaacatatcctgtgttcactaaggggaagtggttttaatgtgcatgaaaagaggctggcaggcgctcaccccacctggaccctagaccctggagaaggggtgggaagttagcttcagtggacgttcctgataaacgtgagctcaggtggctcacttcccctggcctgactgcagacttgagccaggaacacccattccgccttgtgtgtgagacccaggaggatcaaggagatatcctttagcatccattaaaaaaaaagttttttttgagtcctacctctccatttttgctcttccctacttgagctgtcttaaagcatccctggaggtaggaaaatgcatagaccctccttcccagggccccagtactgccggaggagcctcggtgatggctgcacctctgccctggggcctggagctgggctaacgctttcttggaaaacctctaattgtttctaccaagttagccaggacactttttaaaaagcactttcattaaaaatgcataggtatttgttttaatttacataacggcccagaccaaaatgggatgtggcctgctgcttagactggccattatcacgcctctgattcagagaaaaacctaaatttcatgtttatgcaggtcttatagctgatgcgtttggtttgaaggagcaggtgaactaggtcctctccaggacttggtgcttttttgttgggtgtggagagacatgggcgagatggggctgttgctgctgcgctgatttgaagccatctctccagactgaacccgtcctacgtgtccgccattctttctacctatccacctgaagacggaatgtctagctacctctacttcagacttattttctaatttagaatgtacttacttgagtggatgtggttttggagggcctgtagccaaggtcgtgacagctgaataaaatgtttccttctttgcccccagaactgcgctttcatttatcagctgcccttggtgtgttgtatgggatcagccaacattcaggtatttagaacattaagactcagtggcctggttctgtctcaccaagaacacaaataaacagttgatgaatccatcacatcagtgatgaatccagaatgtgtccatcattttcgtaagtcttagtatgcagagaatctcagatagcaaagcagaaaggatgatgtcacagacgccttgggtacccagcacctggatgcagctgtttgtacacacatactttctgatattatgttgacagtgacttacaccacttcaacctcaggcaggattctatcagtttctttactacaaattgatttgtttctttaataattattgtaattactgtcagtaaaaatctgagtatgactcagcaattagttgctggtaactgagtgtgttgtaatgctggggaaaggatataaaacttgtattttgaacagaaaggcacacatgtgggtgagcagtgtttaccaccacagaatttaccgtctacacagaattgagatagctgcacatgaatgtatagtgagcagtgtaagttaattcagagaaagaaaaaattatttcctgctgaaagggttcaagaaggaattttgtaggagagctgggcattgaacaggctcctccagaacatgtgggtcagattggccaccgcatggctggggtcccccatgggccagtgatgcccacctatgggagcaggtgacacgctgcctcccaggccacgcatcgacacccctcctgtcacgctccgtgcttctctgagcacttcctccttccctgtggccctgggctccctgtgggccagccctgtcctggcagagccccctgtgcgtgtcaacgcacatccttcatagatgaaaatggacttgaagatcccgcgttatcagttggttagctctctctcaagtctccttcgtgactctgctttatttttcgagcagcattctggttctgagcgaggagacactgagaggggagaccactctgtggctctaaccccgcctcagaccagggctccgcactgtcctgcagtggcacagggttgctagccttggattagcttttggttctctaatgggctttgcttgcaggtacaaaaatttgggggaacctggaaaaactcttaaatctcctcatctgaaagatattcatacatctactgatgacttccaaagtacaaggtctagaataccaagaggttttatgttgtcataaattagagttttaatgtatataattaggtgaaaccaaatgtgtatcatatacaacagagtaaccgtgttgcaggaattgggcctcgttttcctgttgttttcctcacatctaattctttttctctggaaatgccagggaacctttctttattttctttatttttatttttcagtagagacgagggatctgactatgttgcccaggctggtcttgaactcctggcctcaagtggtccttccaccgtggcctccgaaatgctgggattccaggtgtgagcccccgtgtccggcaggggaacctttcttaagcatgaatggtgtgccctcctcagggtgtgtcctctctgcttcctttctcagtcacatcagcaggtgcttcgtgtgcatctgtgtgcccagcctgggcacagcgggagcccaggccttccttcaaacgcagcctcccctgcacgttccaaacacttactggcatttttcttcaagtgatgatcatggcattggccttacttattttagttgtttttaaaagaaagttttaaaagtttatcaaagtgatgaacatacacatcactttttaaaaacataatccccacccagaggcaaacccttttagctatttgttctagtggcatatgttggtgctgctttgcactgactcatcaactcagggcatcttccctgactgcctggtgtggccccagcactttcacacccgttgttcccctccccaaccccagaaggtcgtagatttactctgtcggttcttctttgttgggagttcaccatgaaaagtactttgcaggaaaagagcaatgatagaactggagtagctcctcgcatgacccacctgtgcccgttttccagcatcctgccacccagccaggtctgtctcctccttggcccgttctcctcactcaggttctctggaagttggcacagttttactaaaataaaatcagcattcatagcattaggactatgtaaacactgttctcaagcaagccaagtcatgtgtacttgggtctgattctggactttgtgtgtgagttccctgggctgctggtctccgtgcccccagcctcgctgtcttaatgagaggccctaggggagcctgcagtgtctggcaaggccaggttgccctcagggctttctgctgccatgattttctggcccttcgtccctgtttgtttttccctgtgaccttcagtagcagcttagctccttggggtatttactgggaatgcattgaatatgtgaattaaacgagcgagagctgacatcttaagaatgttgactcagcccacccaagcagggagcatcttcccatttgttcacgtcttctgtgttttccaggagagctttgaaaatcttccatgtctgtgttttgcacatttcatgttaaacttattcctatgcattcagtctgctctgtggctttcgagatggggttttctttgccatgatgttcctttgtttattatttgtgtatatcaaggctattgattgttctctgtcagttttagattctgctcattcagggttaagggcccaggcaggaggcggagggaggagctttcagcagggcgattccttactcggtctcttcactcttctgccattgctgccatgtgtacattgcaggctccttcatttgagcaaattctctcttccatgctccagatgttttcagaaggaccgcgtacttctgagaaacacttggtaccccagtggcagctgcgtttgccttggtgttgccatgtgacaggcattacttgtttatctcattgttgttcctagtagttctcaatgtttgttgaatgaatatttataaccatcatgtgtggcagttcttatgtagtgttttgatttgtttttttgagaccatctcactctgtcactcaggctggagtacagtgttgtgatcatggttcactgcaacctcaacctcctgggcttaagtgatccttccacctcagctgggactacaggtgtgtgccaccacacctggctaattttttttttttttaattgtagagatggggtctcattctgctgcccaggctgatcttgagctcccgggctcaaccagttctcccaccttggcctcctaagctgctgggattttcggcatgagccagggtgcctggcattacctggttttatagatggagaaactcagagccatgtgtccaggaccacacagctattaactgcaaacccagaggaaagggtaggggatgagttccaagcattccctggagtccgtggtaaatttcttcatttcttctcctgcaacaggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaaggtgggtgtgccttccagcttccttcccgtttctgccaaaagccatgccaattgcggtggtcggagcaggtcctgcccatccgtagcttctgttaagccattgatgtttactgtgtttcaacaaacccaaatgccataactgaacggaccaggtagtcaggcacaaggaggggctgtttctgtggcagaacgtgttcatggaatgactgccttgaagtgtggtgcgtgtggtttatgttccctctgtaagaccagcagttgtttgtaattctccgaggacagacctcgagagtgtctgccttctagtttgaaaaaattgcacaatttctcaatttcgttagaatctttctttaagcatcggtgattttcttagaaaataaagtgttttatatattctaaagggctaattccaagctgccctgcaggtgcaggctctgggcttccctcctcaaggtcagaatcaccagccttttgcaattccgttgcccaggaccagatgaagtgcttgctccccttctgtagctgttgctgtgggtggtgggtgctgactgtcatccccatcctccagggtgtggtgggtgctgactgttgtccccaccctccagggtgtggtgggtgctgactgtctcctcatcctccagggtgtggtgggtgctgactgttgtccccaccctccagggtgtggtgggtgctgactgtctccccatcctccagggtgggaaccttggtctgtctcagagcagccagctatgggtctcactgcgctctgcgtgatgcatgaaaagcagttcttggagggtgcggtggccccatatgtgcctgagcgtgtctatgagggcactgatttggaatccagcaaatccgagtcccagtttcggttgtgctgtcagcctcctgggcttctgcttccttagtgtggacaccgcctcctgccatcatagtgaggactctgactccgtttcttcacacactgaactctcggttcccgcctaccgtcccgggttcgcagctagcattcggcacaggtggtgaagcagtgtgggcccagagcagagacctcgaggaaggcttctgaccctggacactgaggagtagccagcctcggaagttagaaaggtatccacccagctcctcccgcagggcacagggcagtgccatctctccccgtgtgtatctggataccagcttgattttaattcctttcgttaaatattgagtaaattcaaaacgatcgttgtgaaggaagtaggatttacagaagcaggatgtaatgaaccaccaggcgtgcaccacaggcccctggcgtgtctttctcagctgcagtctctcctttccctgccctcccctgtggcgcctggcacagtgaatttgaatttgtccttccctggctctcctctgtggagcccccggtgtgctggctctcaggcacggcgaatccgggagatcgctgctgatacgctgggcggacgctggcgcgctcttccgcagtgcgctttgctcacttggtcggaggctctgcagattcatgccaccgaccccaggggcctgcagccctgcctcttcccacattcgctgtcccctgccgggaccccgcccttctcagtgccttccctgcagatgggcattgggctggttcccatcttgtttctgctgtaaaccgcgtgagtgtttcagctgcccacctttctctccagcactgggtgttgtcacaggttttttttaatgatagactgtggtgtgctctgattttctctgataaccattaagatcgcgcaccctgtgtccgcccgccggctccctgctgctcaaagcgcctatctgctatccacttctctctgcagtgggttgccttttcctatcggtttgagggaattctttgtattccagacagtaatgatttttatgaattgtgtctctcttctcagaatttatgatgtgattttttttcttcatcttcttacactcctgataacttacaaaacttttttttttttttgaaacagggtctctctctgtcacccaggctggagtacagtggcatgatcatggctcactgcaaactctgccttctgggctgaagcattcctcccacctcagcctcccaagtaggtgggactacaggtgtgcaccaccacacctggctaagttttgtatttttgctaatttttgtattttttgtagagccagggtcttgccatgttgcctaggctggtcttgaactcctgagtccaaataatcctcctgcctcagcctcccaaagtgctgggattacagcgtgagccactgcgccccgctcccagttgtgctttttatttgtccttcttgtcttggtgtgctggccgatgccttcagtggagtgaagtggggactgggtggggagcggggagggaggcatctttgtttctcttgtcctcgcagagggagagtttctgtgttcagtgtatgatgtttgccccaggctttttgtaaaacaaaaacaatcaccattatcgaattaagaaagtacaattcttaatttggttttttaaaaaaattgtgactagatgttgatttgcctcccttggttatttgtatgtgtgtgtgtgtgtgtgtgtgtgtgtgtgtgtgtgtgtgttaaagtggtcacagtacttttctcccttaggctggtgctacgttgaatgatactgtatgaccatctcctgttatacacacctttctttttggattaacctgtgttatgatgaatgatctgtttcatgcatggcttattcagtttgcagccattttgtttcatatattaaatctgtgttcgtgagtgagattggacagggattcttctttgtcttgctgtccttgcctaggcggagtaatcaataactgtggccttagaaaataagctgaggaatgttccttctttgtatatatacttgaatagtttttgtgatgtttgaagtatttgttgtctgaatgttgtggaacttacaaagaaagctctctgggtggtattttgtttgtggagagtttttgacttactgatctagcttctttcatggttaaagggtttttctgttagctttgccaactgacttttgcaggaccttgtccatttctactaagcttcccgatgtgttgacataaactggctcacaatacccctttagaaactcaccagtatcgggggtatctgtgagtgaggtgccttcctttgctcttggtgctgggtatatgtgccttctctcttttcttgttgattattcctgtgaggagtttatgtaccttttatcagtcttttcaaagacccagcttttaccattgttgaccctccagaggatggaaggaacagtaggatgaatacctttatactgttcccctgttgccaatttgacactttttttcttgtcccctgaaccatttgaaagatgcagacatcctgacactaagaacgaggatggctttctgtatcaccacattaccgtcaaattgctcaagaaatggaacatcagttctgtgtcatttactatagagtccatgtttgtgttttcccaagtgtttgcaaaatgtgcactaaattagtaggcatttttttacttgttgattttgttgtggacccagaatctaattaaggtccatgcattgcatctgttccttatgcgtttttagttcctcttgcctttcatgttatgacattgactttttaaatgactttttaaaatttaaaaattttgtcttcttttgggaagttaacatatagttatacatcagtcttttttttttttttttgaggttaagtctccctctgtcgccaaggctggagtaacagtggcgtgatcttggctcactgcagcgtccgcctcctgggttcaagcaattcttctgcctcagtctcctgagtagctgggattacaggcgcccgccgccacgcccggctaatatttgtattttcagtagagacggggtttcaccatgttggccaggctggtctcctactcctgacctcaagtgatctgcctgccttggcctcccaaagtgctgggattacaggcgtgagccaccgtgcccagcagtcttttttaaaataatagacatcattttttttaagagcagttttaattttacagaaaaattgagcaagtttattgagttatatacttccttcccctcattttcctctattgttaatatcttgctttggtttgttatgttttttacaattggtaaactgataatgatgtgttataattaatgatgtccatatttacactagggctcactcctagtgatgtacatgctgcagattttgctgaatgtgtgatttcctgcaaccaccgttaggttgccacacagagtagtggtgtccttcaagtcctctgtgcgccccctcatcttctctcccctagcatttggtcttttccagaatgtcctatagttggactcatatagtatgtagccttttcagacaggcttctctgactcagtaatatacgcttaagactcctccgtgtctttttgtggcttgatagctcattttttacaattactgagcaatactctactgtgtgaatgcaacactgcttctttatccattttcctattcaagggcattttggatactctgaacttctgacaattaggaataaagctattattaacgtgtgcaaatttttgtatggatataagctttccattcatttgggtgaatacctgggaatgggtttggtggatgattcggttagagtatgcttagctttataaggaactgtgaagctgtcttccaacatgtctacgccgttttgcattcctgccagcactgaacgagagtatctgttgctccacatgctcatcagcatttgatgttatcagtgtttggattttagccattctggtgggtatgtagtaggatcttattgttatttcattttcaatttcgtaatgatgtgaaattgggcgtctttgcatgttcttatttgccgtgttatatcttctttgatgaggtatctcttcaggttttttgcccattttaagaatcaggttgtttttcttgttgctgagttttaagagttctttccatatttcagatgccagttttttgtttttgtttttgttttgagatggggtttcgctcttgttgcccaggctagagtacaatggcgtgatcttggctcactgcaacctctgcctcctgggttcaagtgattctcctgcctcaacccccgaagtagcagggattacaggcacccgcctccacgcccggctaattttgtattttttttagtacaggctgatctcaacttctgacctcaagtgatccacctgcctcggcctcccaaagtgctgggatcataggcatgagccaccacacccggcctggatgccagttctttatcagatatgtgtttcgcaaatatgtccacccagtttgtggctgcttgttttcttttcctagtagtggatgttcgctttttgacgagtttggaccagtgatcctccaggatgtcccacattctagtttaatttcttcgctttttcacaagtttttgtcaaaccagattaaaaaaaagcatgatcaaaccttgtgctgtccatagtagatgtattttaaatacaaagacatatgaagtttgagagtaaaagaaagggaaacgatatactatgccaatactagtcatagaaaaccagtgtggctctattaatcagagaaaatagactgcaagatgaggagtattattgatgataaagagggccatttcctcatgataaacaggccagttcatgagccaggcacacaccatcctgagtgtgcgtgcgcttaatatcagagtttcaaaggacatgcagcaaaatgaacagaattaacaggaaaagtatgcaaatccataatcatagttggaggttagaagatcttcttttagtaattgatagattaaactgatagttaaaaattatagacaaaattgatagttaaaaaatttttttttgagatggagtctcgctttggttgcccaggctggagtgcagtggcgtgatctcggctcactgcaacctccacctcctgagttcaagctattctcctgcctcagcctcccaaggaggtgggactacaggcgcccaccaccacgcctggctaactgttttgtatttttagtagagatggggtttcaccatgttgactgggctggtcttgaactcctgacctcaggtgatctgccggcctcggcctcctaaagtgctgggattacggatgtgagccaccgtgcctggccctgtaattaaaaactttcttattgagaaaactctaggcatagtatattttttctagtccaaagcaaaagccagtattaatgtaaaagacctagcaatattatcaatcaccccgacttaattaacatttatacagccgtccacacaactgtagaatatacattctcaagtgcatgtggaatgttcaccatatgctgagccataaagatgtctcaataaagtttgaaagattaaaatcatagagtatattctctgttcttgaaattcaaaattatggaatatctggagaagccccagatacttggaaatgaaataccacatgagtcaaagacaaaatcataaaagaaaataaaaaataattcaaacctaaagataatgaaactatgacacccaaatttataggatttaggtgtaacagtgcttatggaaatgtacagctttaaattcttacatagaaagatacattttagaaatatatttaaaatgaaaatctgtttttttgaaacggagtctctcgctctgtcgcccaggctggagtgcagtggtgccatcaccacccactgcaacctttgtctcctggattcaagcaattcccctgcctcagcctcccaagtggctgggattacaggcgtccaccaccgttcccagctatttttgtatttttagtagagatggggtttcgccatgttggccaggctggtctgaaacccctgacgtcaagtgatcctcccaccttggcctcccaaagtgctgggattacaggcgtgagctactgtgctcagcctaaaatctaatattctgccttaaggaaacagaaaatgctgagcaaattaaactcaaagcagaaggaaagaaataacaaacagcagaaatcaataaaatagagtacaggcaacagagacaacatagctaaaatgtgttttttttgaaaggatcagtaaaagttgacgaatctctacgtaggtagatcagtgaagaaagagagaaaacactttatcaacatcagcaatgaaggagaggatatccccacatatcctataagcattaaaaaggtaagggaatattattaattttatatacatttaaatatgtaattaaatggacagatgccttaaaatacaacttaccaaaactgacctaaaatgaaatagaatatctgaatagccctatatcaatcggcttctttccaaggccatgccaggcatttaatccctgtgaggccaggggctttttattttgtttactgctacattccaagctcttaagatagtgtctgttaccctagcaggtgtttggtaattgtcaaccacatgggtgggtagatgaatggatgtttttatttttatgttttttttttttcaattttttatttttccataggttattggggtacaggtggtgtttggttacatgaagaagttctttagtggtaatttgtgagattttgctgcacccttgtagtcttttatccctcgccccctcccacccttctccccaagtccccaaattccattgtatcattcttatgcctttgtgtcctcatagctcagctcccacgtaacagtgaaaatatacgatatttggttttccattcttgagttacttcacttaaaataatagtctccagtctcatccaggtcactgtgaatgctgttaatccattactttttatgactgagtagtattccatcatgtatatataccatattttctttatccactcattgattgatgggcatttgggttggttccatgattttgcaattgcgaattgtgctgctataaacatgcgtgtgcaagtatcttttgtgtataatgacttattttcctctgggtaaatacccagtagtgggattgctggatcaaatggtagttctacttgtagttctttcaggaatctccacactgttttccatagtggctgtaccagtttacattcccaccagcggtgtagaagtgttccctgattaccacatccacaccagcatctactgttttttgatttttttattatggccattcttgcagaggtaaggtggtatctattgcattgtggttttgatttgcatttccctgatcattagtgatgttgagcattttttcatatgtttgttggccatttgtatatcttcttctgataattgtctattcatgtccttagcccaatttttgatgggatttttttttcttgctgatttgtttgagtttgttgtagatttccggatattagtcttttgtcagttgtgtagattgttaagattttctctcactctgtgggttgtctgtttactctgctgactgttccttttgccgtgcaaaaggcctttagttaaattaagtcccagctatttatctttgtttttattgcatttgcttttgggttcttgctcatgagatccttgcctaaaccagtctctagaagggtttttccaatgttatcttctagaatttttatagtttcaggtcttagatttaagtccttgatccatcttgggttgatttttgtataaagtgagagatgaggatccagtttcattctcctacgtgtgacttgccagttatcccagcaccatttgttgtaaagggtgtcttttccccactttatgattttgtttgctttgttgaagatcagttggctgtaagtatttgggtttatttctgagttctctattgtgttccgttggcctatgtgcctgtttttataccagtgccatgctgttttggtgactatggccttatagtatagtatgaaatcaggtaatgtaattcctccagatttgttctttttgcttagtcttgcttcggctatgcaggctgttttttggttccatatgagttttagaattgttttttctaattctgtgaagaatgatggtggtattttgatgggaattgcattgaaatgagtggatatttttactgaaatgtcatctgatcaccagatgtggcatgcacccctctccttgactctttagtcctcctggtgtggtctgtttttctccacagctttttcccagtcttatgtatattgtctctatgtcaccattaaaatgtgagttccaggataacaaggtctttgttctatgaaccgctttatcatgggtacctaaaaccaagcatctcagaacataggaaatggtaattcaatgttcactgcattctacgctaatgtcataaaagcaacagaatgatccctagagccaagtctttcttggttgtattttcccccactgtgttattccattagtttatcctttcataggtttattttgcacatcacgtggcatgccaccggagacaggcgcgtgttcttccagatctagacagccataagctgcactgtagagcatgcagtcctgttgccgagtctttcagccttcagataggctccctccatcaaaacgaagcctgcagcattacagatgatacactgtcggtacacaatgtaagatttaaaaacatttaaacatgctagttttaactatacttttctttttgtttaatcaccatttattctgttgctggttgttttctcagcctcagcagaaaactgaggttcaggccttaagcaaaatccgggctcagattttccccatgcaccgccctcccttgcattcccctgtctgtgtttcaggcaattaggactggcagctgtagccattaagaattcacgtagcggaacgtttatcgggagaaggattaatccactactcgaatactcccaattagcttttagaccctgtctgccttttcttctttgcaaaaggagaaaggtttttcccacttgatacattttttttctctgctttttagagttccattgtgaccagaagctatttccaccctttgctgtgtacctaggcacaaagctacaaggcttttccctgtgtgtacagctcatggtgccctctctaggtaggatgagctttgctccaggttacctgcctttccttaatttactgaacataaagttggagttttatgtggttttgcatttttggtttaggataatttttaattcttcggtggtcttcctgtggtgtttacaacctaacccctaccctctgccaaaatcatcctcaaaggccatttttgtcttgcactatgttctacccttacccctccggacattaaatagggacataaaatggatcttatcatggagagcacagacggaaagcaaagactgttttgttctgattgttggttataagtctagcttaaagccgaattgcatgatgatgtattgtgataatgtagggaaaatattggccccttcagagagagagagagttgtgccagcccagccatggtgggcaggcaaggttggagggggcctcctggagaaggcggtgcttgctcgggctgagtcttacagaagagaacaaaggcaacagttgtccctgagaggggactggaggggatgatctcagaggaagtagatgatataataaaccagcatggtattcattggaaactacaagcagttctgtgctatgggagcctggagcctgaattgggtttcaaaagaaagaaggccagaaagtgttccaggctaaggcatagagcacctcgcagactcttagggatgtgggcttagataaatccttttgatgccgtgtgaagcctggctctggggagaaaagactggctagagaaactccaggtagaaggccgtcgtatacaagaggccagtggcggcaccctgagtcaggctggtggggcgaccctcaggaccttcctaggacaggtggaggttgagttagagggagcaggtgagacctggactgtgaccaggcaccagaagcgagaagaaggagcttgtgggcatttgttctcaggttgtgagtaggccggaggtccatgagtatggggtcgtgagaagtaggggcagacatgctgcgggcggttcccaaaatacagtttctagagccgaagaaggccaagagagtgaaatctggggagcagaagaggatcctggcaggtgatggggaggagaattgggagaaaatggcatgggggaagccgggaagggtacctgtcagcccgggggaacagagatggaattgatatccattattccaaggagtctggccctttagcaagaagagcactttatattccaagtgaagcagtcctgttcaaaataagcagctccccatttctgagaagatgctgagtacatcttctgccagagaactcagaatgtgaatcagaattctcagccctattaaagtggcatcttctcagggctcgttcctgtaaagccccttaagggcacagccttcctttaaactctcagccaggaactgtggtctcatctggatttgccgccgcagctttccctggactaaagatggacttgtgccaccattctcagaggagggcaaaggacaggggtcagcagattcctcctcctcctgaagggggttcttgaatacatatcatccagaagcagggggtcgtggccccgaaaggtcaggagtggggggaagcggtacttgtgaacagacaactcgggagtatacatcaccagtaaaccccagtcccgtaaaatccgtaaggctgcaagcttattgtcattggtggtggtgtttttggtacttcctctgcccttcttttattacagttaaataattattccatgagcaattctaaataaatattatttaataggatttattggttttttgtttttttaattgggattgtcattatcaaatagatgcctcttgtgttggtatacagttaattgttgcttctgttgaaagatggatcatgggccgggcacggtggctcacgcctgtaatcccaacactttgggaggccgaggcgggcggatcacctgaggtcaggagtttgagaccagcatggtgaaaccctgtctctattaaaaataccaaaaaaaaattagccatgcatagtggcgggcacctgtaatcccagctactcaggaggctgagacaggagaatcgcttgaactgggacttggaggttgcagtgagccgagaccgtgccattgcactccagcctggacaacaagagagaaactgtctcaaaaaaaaaaagatggatcataaagcttttgaaatacactattatcagaaaaatacgtgatttttaaaaagtgatatttatgtcagaccacaattatcatttgttaaaattgttactttattcgtcttgagaatctagcggtgtccaagaaaaagttttatggtaaacttgacctttcttttctgagaaattctagcattttgtgtttgcttacagtagtagaaggccattaacaaaaactccatttctttgggagaagtgctggaaatgtttggagtatttctttatgagagcttaaactttaacaaacaaatgatttccttgatgccaagagatacaaaacctgagagtgcagctgcactgacttcgcgggtgccctgcatttaaaaccacggtcatagcgctgcggtgcccatgcttgagtgcgcccagcatcacctgcaggctcacggagccacagactgccaggccctccctgagcctctgcttctgtggccgtgggtggggcctgacgatttggctttcttgggtgtcccacaaaattgctgctgcggccgcttctgctgctgtctgggttgtctgcctttgagaacccctggtatggacagtgtggtgtgagaggcaagcaggatattcatcttatggtttggggtcactctgcttcttacgtgtcgggagagacacttccccgaccccttgttttccatctctaattttagccgtctagggcagaaacagtcccgggtaaacaccaaggcctcgtgggaggcacctaggaggtgaggaggggctacgtctgccgggtctccaagcaggagtgagaaccagctagacaaggggaggcctgggagtgcgagggggctctggtgacaggaagtagtcccctctgacccggtgacaccgtggggagcaggtgatgtggttccagtgctctgtcatcctggggtcagtaggatgaaagatgtcgtagcagcacaggcagcactgtggaaactgttctcacgactgtgagtcattgaggctcctggacgcggcggaagtgcaagcgggaaaaaggatggcaagttgagtaacctcaggggtaagcaaggaggtgtgagaatcactcacttcctcggcagggcctgcacgcacctggtgcaggagcagcagaagccatgctggctcttcctgctgcgtgtgcatctggccctggaaagaggcacacccagcagcgggctctcctggctcacccggggccgtcagggcgctgcagtttgcaggagcatcctttgggctcttacctcagtcggtggggctgggcagctgggtgtctccagcccatcatgctggaacatgctggaagcttcctcagggtactcgggcttattttggtagtcatacacatgaaatgcactttgggggagaaggatgaaatattttggttaatccactgaaaaaatgaatgttgaggaacacagccagctttcctgttatttattaataggcttaagatagccagaaggacatttctgctagaaagttattgccagctgaaaaagaacaagtcttcattattatccaatttggtatatatatatatatttcaggtttttatgaagctaagggcaaaggtcagctgcttcctattccttgtggattgtgctgctgatgggaacttcctttgacttcacaaatacaagggattggaagtgcattctttgttatctcatatgtaagatgaggcttttaacacgattttcttttagttaattttaaaatattttattataaaattcattttttttcaaatggtgcagataagcataaaataaacaataaaagttcttcctttccttccctccaagcctttgtgtggcacgttcttggcatgttgcaaagtgccgtcatcatcatcatcatcattgagtttggaagaggaaatgataagttttatttttcccttctcaaatttttgaatttgaggtgtcacaggcaatcaaatgaaaataaccaactctctgtagaggtggtagttgcagctgaacatttttgggacttcaatgtttaggcagtatttaaaaccagggagttatatttgattgcctgggagaagatgtggaataagaagaatggaataggcccctgacgataagtttttaaggggagggtggaagggaggggtcccaagctgggaaactttggaagaatgagctgaggcagccggagacctggggagagagtgtgtgtttgaggggagacggcgcatagatgtcaggtggggcaggaatggaagagaccatgggatgcagcatgtgaagaggtgactatgtgttcagtaatttctggagagcagttaggatcaaaactaggtttgcatttttaaaaaacaatttgaaataattttaaatgtacacgagagttgcagaggcagcacagagagttcctgtgtgtccttcatccagctacccagtgtcaacctcttacatgacctcagcacagcgatcaaatctaggaaacatatgttgttacagcactgccaaccacacacagcctccttggtgccagcagccttgccgctgtaatcctctgtatgtcttgtggtccagcccaggcccccacccacattggctgccttgtcctctggtcctcccagcctgggatggttcctcagctgttcttgtctttcatgaccatgacattgtaagatgctgctcaggtgttttggaggatgtccctcactttgggtttgtctgatgtgttctcatgatgagattgaggatcaaagttttgggaagaataatgcagatgggttattctcagtgcatcaggtttgggggtgcgtggtgtgtgtgattcttattactgcagataccaaccttgatcactaggctgaagtggtgccttgtgtgtttctccaatgtgaagttgttattttctttataattcataagcatttgaaggagatactttgagagtatgcagatatcctgtttctccttaaactgccatgccctaattctaacattcatgtgtaattactatcctggtgttctaatggtggtgctgtacctccctatttccttccacgtttagtaactggaattcttctgtatgaaagaattgttgcttctcttgttgtttatttacttggttgtttgtttatatccatatggagccactaatatttattttacttcttgggttataatccattattattatcattatttattttgttactgaaattgtttcaactttgaccactgacacaccttctagcattttctctaccacagccctggatcaaccatttttccaaggatctttggcttttttgagagtgggatttagaaaccaagatgtggcctctttgtgtgctcgttactactggagcattagtgttactaggcctaggccctctccgtggacttagctaagtgatgcatttgtgtgtagtaagctgtaaacacatgcatattgatttgcgtatctatgtacaggtgtggaaactagattttaatgactaaacaggaggtaagggactagggactggaatagactaatctttccagaagtttggtgatactactgaataacactgttttttctagctttctctgtaatacaatttttgcaataaatacatagagagcatgtgattagaggagcctgtctgttggggagacctcgaagaaagaacaaggctaagcagggatgtttagtttctgcaagaggtaacttatgtttgtagataggagaaagggggttgctgaagaaagtataaatcagtggagtaaaggatgagaaatgggaaggtatgagaagattaattcaggacagagatacagcatttgacttggcaagcccaagcactcttctctgagacgtgggagggaaggagaggtgaatacaaatgtggtggagctttgaagctggacatgagagctggttccccttggagcctgtctcctgttaagtgagaagccaggccatgtcctgagaggtgggggccatgagtgccaggatggaagggtcaggagagaggagacatggcaacccaccccttcctcatgtttactgcctggcatagttggcatttttctttatgttgaggaaaatgctgctatgatctgattagtaggtgctaaataccccagtttgtataaagtaggatggtatctttgcagggctaatgaaatggccaaatcaggtttgggtaaggccacctggagatccatgtccttcagctgatggcagtcttcctgtgtatcccagctatccacagagatgcttgcgagttctaccatcgcaacagcggcgaggccaggttctcccatcccaacagtggtgaggccagaaatttccaggctcatcacatctacctgctcagcctgtggtgggttggagttggggttgggacaccccacctgcccttccagagggcgactgtctgcacctgcccagtgtgccccccgttccctcctctgcagtgtcagagctgctgtgcctggatctgaggaggggccgtgggagaagaagccgcccccacgacacttgcgcttgccttttcagctggagcacggggtggcggcaccgtgtcgttctgcccacctcacccactgggatgcaaacttgctgaggccagggcttcttcctgccatgccttgccaccacgccccttgcctcccctgggacatgccgttctcttctttgtactcatctgtttggtatgtgaggggttttgcgttttgtcttctgctctgtaatttaaagggataaaacgctcacatttaacttaagccaaaacccagtttcagtctttccaccagaaatccctgagatgtagaattgtgggaagctccttggaggctggcgggctgctgggctgcccctctgtgggaagacagcctgcaggcttcagtgggctgggctctcccggccatggctgccttggtggctaactcaggctgcggcgacagactggtgaggcaggcggactcttcccctgatgtttaatataacctgacagataaagtggattgtaatgaagaaattatctaaaacccatttctatttctttgtttgaaaagaaaacatggccttgaatatgattcttggagaaaaagaagagacgctttgattaggaattattctctgtacttttagttttggatcaagaagaaatgaaaaccattggccacaagctcttgagtgttccaagcagccttccgtgtatacagggggcttttcaattctgggctggtgtgggttggtgcagtcaggatgacagaggaatattccacaggacaacgaggagtgactctactgtgggcgttgtttctgcccctgcagccggggctgtgaggctgcaggctgccctttgctggtttgcaggggccataattctggcctggagcttgacaaacgacccaggacctctgagatgggaaatgaggtctgcatcccgtgttctaatcaggattcgctatcaaaggtcattttccacactgtggcttaatagagttggttttatattccctgagggatacagacttccaaattgttgcagtctcactaactgtaatgtatacagctcatgtttgaaaggaaatcgcctctcctccaaggcagcggttctcaaccagggaaacttttcccctcaggggacactgggacatttggcaatgtccagcaacctggagattgtcacatctaggtgtgggggtggctgggtggtgctgcggaagattgtgtggtgcacagggcagccccacaaggagcggcccggccccaaatggccctggtgctgagagggacagacgccgctcacagagaagcgaccacagaggcccacatccaagcaggcttcccagagcaggcggggctgggaaagctgttctgtggcgcagcatcccagtggctgttacggggtgaaagcccctcttagaatttaaagtcctagagcagagaccaactggggccatccatggccctgtgccgtgctgcctcctggacgcacgctaggaggtggagatggtccagccccagcaggactgggccacgaggaccctgccggtaacctggtgctcgccgcccacagatcacggggcgtggagggagagactgccagtgctgtcctagtgcagcagtacctcatggttatgacggatcatcttcctgaactttgcatctcagaatttaaaatggagattttgattttgattttggcaaatgtggaaaatagatttcagctcaaaaagcaagacctgagaacatggtgtgttaaaatatctttcatttcatgccactttgcagccctgggaccctcggggttgtacctagaaggtagtaaagatgacagcagcccccgtttcactgatggtggcgcagaggacgttgtgaggtggctgtagggtcaggtggctgtagggtcagggctgggcaagttgtattcagatgctgttcgctaagcccagaacattataggaggtaaataaatagcacgcagtgttctgggggtaaaaagatacacccatgtcccaggctgctgccaaaatcctttctcctgtcagcgtggggggtgatcctgcccaattaaaggacgtcttttggcccttctttcccttggcagcagcatggaagtgggtgggggaggagaggagcatgcttcccccaacccctggggacctgtgagcgcagcctgcaagctccggctccaggaggaagcgtgctcaagtgcacctctgaccacgtcacgctgcgagaacgtgggcgctacacctccgaccacatcgtgctccgagaacgtggacgctgcacctctgaccacgtcacgctccgagaacatggacgctgcacctctgaccacttcctgctccgagaacgtgaactctgcacctctgaccacgtcacgccccgagaacgtggacactgcacctctgaccacatcatgctccgagaacgtggacgctgcacctctgaccacatcatgctccgagaacgtggacgctgcacctctgaccgcatcatgctccgagaacgtggacgctgcacctctgatcatgtcacactccaagatcatggacattgcacttctgatcatgtcatgctctgagaacatggacgctgcacctctgatcatgtcacgcttcaagaacgtgaacactgcacctctgaccacgtcacgccccgagaacgtggacgctgcacctctgaccacatcatgctctgagaacgtggacgctgcacctctgatcatgtcacactccaagatcatggacattgcacttctgatcatgtcatgctccaagaacgtggacgctgcacctctgaccatgtcgcgctggccagaatttggctgcaggacagacttcactggaaaggaaactgggccatgtgctcagctacaactgctttagaagagagagaaaatcagatattagcctagcagtctctaccacactggcatttagataattttcagcttttttttttaccagtcaaaacatctcatgtacaaatgcaagtatttctataggatggatatctagaagtagtcagaaggaatgtgcctttaaaatttttgttaagtacttcccaattgccttccatacaagcttcattaatttacattcccaccattgatggatgagtgccctgcatcctcccacaatggggcattattcacattttatcctgctttccactttgctgaataaaaacagaatggatgaatgaatggatgggcggatggatggatggatgaatggatggatggatcgataggtagatagatagattctcattgtaatttgcatttctaataaagagcatgaaacttagaatcatttttgattcatttttcttctgtgaattgcctgtttgtatgttttgcctgtttgttttcgttttgtcccttgttgatctgcagcagaagtttatatagacacatctaaaaaattctctgtcatgtactgtgtacctcctttcttctaaaattgctagtcattgatatgtctttattagaattatagatttttttatcttactgtatcagtcagtctcaagacttattaggttttgtgacttgcttaattaaggcctttcatatgccaaaataaatgaaaattttcctgtgcttttacatttaggttttcagtccactctggggtgtgtgtgtgtgtgtgtgtgtgtgtaatctcagatagcaaaataccaaatggctggttagagtttccagcatcagttattgaattgttaattccttctttgcagatttaaaatgctgtcctcattagagttacgtatgtgggtctatttctggactctctcttttctgttgatttgtttgtctccctcactaataccatcctgtaattaccatagatttatagtatctttaatatctggcagtgtgagtccctattcattattctttattaatttttttttgctcttgtgcttttttttttctctgtactatataatcatcttgttaaattccgtgaatggaaaaaacccagaaggtattttgattaggcttggactgactttctggattcattaggcaagaattgacatctctagatccttcagtgggtttatttacagagagcatttccaggtgttctattatagagcagtgattataaacagtccaccaaacgcggacagttttaacaacatgtttggcagagcacaggtagaatggggtcctgcccacgatgatgtacgtgtctccacacaccccccacacatctgcgtcgttggtatactgtatcatcatgtctgagatataacttacgtctgagatgtagctgatgtctgaaatgtaacttttgtctgcttctttgctgtgcacggacaaagcttctgcaggcttcctgcacgccatacttccccaggctttgctggatctggccttctgtccctttcctcttgagttataaacaatcctgtaggcagtaccagcggcaggatatgtggcttagctgctaagaaataaactcacttttactgtgactttgatttttgccaatttctgggaatttgatttctgccacagcttcactacttacactcttgatgtccaaggaaaggtaaataatgaacgtgttctgtggagaagaattccttaaaaatgttagctttgcgttcggattgtaagtgtttctcaagtgagatgagaacattctcctctgcatttaccagaatcactagtgtctgttcaggcgctgaacagtatggtgtgttctgaaaaatgtttcactcagcagattagtgttactaggttattgttctgtgactgaaataaatttatacagccaaacccacttataccccttaagtatgatctttcaaaagtcatctcaatgacaaagtgcttatggacctctctgaaattaaagggacagtggcatgcaaatttgaggacccggccaactcttagagctcccctcccttgtaaatgatgtgtgtgttgtgttatataaacccagagatgtgacagagttaaaggacaaatggagacacggagtgaagagcacgtgtgtgagacagctgtgggtccatggagggaggccccgcggcgggaactgaggcagccatggggtacatgagggaagccccacagtgggaactgagacagctctggttccatggagggaggtcccgcagtgaaaactgagacaagtttaaggagttgaccagcagctgaacccagcggcagctgcggaggagcctggggctagggatgatgactttggcagccacctggtgtgggcgctactggagtaaagcagcatcagaggagatgtggagaaattcagtttgatggtttttgttttttgagactgagtctcgctctgttgcccaggctggagtgcagtggcgcaatcttggctcactgtaaccttcgcctcccgggttcaggtgattctcctgcctcagcctcccaagtagctgggtttacaggtgcccttcaccatgtctggctaattttgtatttttagtagagactgggttttaccatgttggccaggctggtcttgaactcctgacctcaggtgatccacccatctcagcctcccaaagtgctgagattcaggtgtgagccattgcgcctggccagtttgctgttttttatagttttgtataaaggctaactcagcgtctctccagccaccaggctcaatgtgtgtgccttttgtaacggtgcagtactcaccagcagcccatattcctgagacgcacatgtaacgagcgcactttgtgtgttttctagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtgagcgctctggtgcttggagagcggtgctgggtttggttttgttttccctgggggtggggtttgggtggggaggttgggaggtgttggacatcctctgaatggagcagggctcagaatgccaagggcaggatggcatattcaatgctgttgagctagggaggcactcagcacactttatttttgaaacataatcttgttctgttgcccaggctggagtgctgtggtgccgtctccagtcactgcaatgtctgtcacctgagcccaagcaatcttcccttctcagcctcctgagtagctgagactacaggtgcacgccacgccaccatgcctagctaatttttgtagtttttgtagaggtggtgtttcgccatgtttctcagcctggtctcaaactcctgggctcaagcaacgcgtgtgcctcagcctgcaaagttctgggattacaggcttgagcactgagcccggcccagtacaaacctacagacttatttttacatctcattttactcagtgtcatttttaatccaaacattaattgataacattcatagggtcgatttgtgccccagcagtctctgcctccaagataaatgtgaaaataaagcagacacatttattttaggagaaatggacccacagcttcagttccaccagtgcctttgttcctgccccggtttctttttctgttgtgttaaaaaaaaaaaaatccccgaaaaccactaagctaaaatgatagaaaacaaacgaaaacagctactgttgtagcgcccacttcaaaaagcggaaagcctgtgcaccgctctgctaatgaagagacattttgcttggttgttttaattaatatttgatgtttgaattaaacagtgaattctgaggacaaattgaagaggcagtttcgattaagaggcctccatcttgtggcctgcacaagagtgtcagaatgaaatattctgcagcctcaagggggtcatgagttctactggttgcagtataggaaattctcaatttaggagcaaaaatgatcttgagtatgtttcctcaagcctttttgaatatattcaattttaatgtattatgttttcacatttcatcatagaaaaatgctgaaacaatcagtaacaaaatttgaaattctgtttggtagattttcacattaacatgtgtacagttgaatattttataattattaattctttatgtggaacaccgcaaaagagtgactgataagtataatgtggtttatccatgaaaaaggatccacatgcaacaagtttgtttgttttgttttctatgataagggaaagaaagatcaaggtttgtatcatcagatttttcccttgctttcaggcatttcatcttggtttacccaggggataggttatctaatgagcattaagaaactcaaagcattgagaggtaatttatttttccttgcatcaagtaataaatatcgcaaaaaaaaggtgatttttttacatttataatatgtaaataaaaatgccaaagaatcctgcctgagttctacaccagatttatgggctggagagtggttaagggaaagaccaatacatcagcctcagttaattaaaacatgttaaatagagacccgctcccctttcagcagaagaccagcacctccagctcatgcataataccaaatgcttgcattccagcgctttgagcatgtgctccggcagtgctgtgtgtgctctctgtgtgttgccagggattaatcagcctaagacactgttcatttcatcaagtgtaacagaaaagattcccatgcatcttttttaggaaaaaaaaatgtttgactcattccacatgaaagagatcagatgaaaaatatgttaactgagttggcgaatagatggcaaggcaatgcgataccgtatgtctttaattagctctgatttttatcttcgttctttaattacaatgtagatcagtcttgtgtgtttctattacacttactattattggctattgttcacttggtctcttataaaaacagtggaaattaaaatgataaaattagctcctagctaatagcttaatgttcattttagtaatttcactatctgctagagaaacagcaatcctgtgtagcctgttagggtttttcttttaaaatattctttgcctctttacagctggtcaaattctttgtaaatttacaatatgttttaatactttttattgtataacatgtgagctgaaagaaattgacaggtgaatgatttgttccagggtttaaaaaataaacaattgattaaatataatgcaagaaaatggttatttggaccagaaagcctccaaataataaacattaacacaaatatgagtgacataaattttaagagatggtgatcagctttcatattcttagtggcacagtgcttgtcctgggaccaggaggtttatttattgtttacttctctctcagaggagtgctgtaggtagagtagaagacgacttcatcaaagcacagatacagtattgcacacacttcaaaccatcagagccggaaaatgacatatctgtcactcagtaatccttcttatatttttattgtgtcatatttctttgtaatttaaaaattaaggataatattcaagtctctccgctttcagtcttcttttataaataagtatattttaccaaattagtatatgccatggtttgaaaaatcaaataatacagaaggtttatgatgaataaagtagtccctggccccacgctttctctgctgagactctatgaccaaaggcacctccttcccctgtttccatttctagttcttctggagggtgtctccttccctgtagatgacatgctgagaccactgcttcttgatttgtcgtttttagattatcagtgggctttgtcttagggtacaaaccaagaacagagctgccattaagttctgtttaaagaagggagaaacgatgtggaagcctgttagcaaagaagtcaattatgtgtagattacatgctggtttaaattcctatgtgttatttgtattcagtagtgaattctaaagagaaaattctagattgaagaggctgcgtcactcacgacgccttcttgcgttccctcttattcactctattgggtttctttatactttgtaaactttgtggtttcaagtaatatccttatgcttttatttctagttttatcagtaatagctcatttcttccattttcaaggctcttagcttccttgtactttcttctgccttttttcttttacagcttctgttatctgcactttctgtgattgtctttcgttctctgaccacgattaacacctctgtgcttgagtggagattgattctataggaagacaagcattaaaccttgtacctgattatgaccacataaatattgctcgctcagtggctagagtactgtgatttccatttttataactgttttcgtttgtttgcttttcctggacatttcctcttttcttcttgaattacctatcgttaccacttcctccactgatagatccacaaggagagcggagagcacagaaggcgccctctcccctcacatcttccaagctctcctgcctcgctcagccgatcgtgcctgtggcctgctccccggcgtcagctggctcccctttgtaattctccaggatccgtccctgtgtctagatcccacttcttcccctctctcgattttctcctttgttctcctaggggaaatcctcaagcactgccctaagaaaggatgtttggcagtctgagaccatcagtatttgaagcagtggaagtaatgaaaaatctcattactgggttttaatcaaatagcagtttgtctttttcactaataaggtctctgaggcaaatgatgacttttcagcagtgccactggggaccaggcatccttagccgactggctttatcctcatgtttgcaatatgcccaccacatctgcaggtgtttcatctgcttgggaggcaggaggaaatggggaaggggcagtgctggccacagctgtctctttataaggaagaacagcccgccctctgtatctgtggcttccacatccttggagtcaactaactgtggctccaagacattcggggaaaaaaaattgcattgtactggacatgtacacttcttctcaccattgttccctaaacaatatagtataacaactacgtttacagcattcacatggtagtagatgttataagtagagatgatttgaagcacaccaaagtctgtgtgtgggttatatgcaagcaccacaccattttatatctgtgcattggcagattttggcatccatgggggtctaggaaccaatgccctgtggatattgagggatgactgcaacaagcagacttcgctttagaccgagttggccagagccaggtcacgtagcaccccaggtgtggttgaggggtgactaaagggagtggacttgggggtggctgtgagatgatccaatgaggaccatcagccacattacctgggtaatgtcatcattctaaccacatccattatcgatagtgtagatatggaattttaggcaattttcactcttccagtggtagccctgttactccttgcagtggatgagtagatgttcttgataagtctgccacctccatccagataaatgccataagaggaatatttatagtcatcgtacacagtatatgtattgactgagttggagagagagaaaaaaagagaattcaaatgttttttaacaacttttatctggatactaaatccttagcctgtaaactagaaaggaaggtgaagtcttaaagaaacagatgctcttggaaacggagcccatgaagtcttgtccgtcagtttcttctagaggatatttctcaagggcagtcacagctcaccgtcactgaagacggcagtcaagcccggagtcaaatctaggcgagtttctcctctttttaatgggaggccagtagcgagttgggcaggcggtaaagataataatgcctttcttctgctgggacagcacgggctccactgccccagtaagtcttgttctgcacatagccatctgcttttggtttagggctggagcataggcaagtttttggtgggagccatggaaatagcctgagaatgacttcctggagagcaggttgctgtgtgtcagaagagtcttgtatgaaagttcagccctggccggtgcggtggctcacgcctgtaatcccagcactttggaaggccaaggtgggcagatggcttgagttcaggagttcaagaccagcctgggcagcatagcgaaaccccatctctacaaaaaatacaaaagttagccagctgtagtggcacgcatgtgtcatcccagctactctggagaccaaggtggaagggtcgcttgagctcagagctggaggctgcagtgagccgtgattgtgccactgcacctcagcctaggcaatagagtgagaccccatctcttaaaaaaaaaaaaagttcagcccatggatcatgggcacaattcacttctccactattcccccgcactctgcaaggcttttctcaggatgcttccgagtaactcgtgtttgtgtggtgtctctaaacacaattgtgtggtccagtcctgccacctgtagcagtacactcccaaagcacagaaacctgtccgacggtcactcactgccacagcgagaagcttgcttgggtccacagcctccccaaggctgcagtgacttaaccgccccccgcccctaccaatgtgaaaacctatacttaaactgataggtgatacattggcctcctgcactgatccccgtagctaaattttatgtcaaataaatattgtaattctgccaaaaatgactaacgtctagaatcttcaagtttcctcaaaaatattaaatgcatatctcacagatctaaagtactcatgttctgaaatcttcttcatttctttgctactcttgtagacaggcacactgcttggctggcatggaattctgcagcaaaaggcagttctcctgctgaaggttgtggttgtagtgattgctgaataccatcagttagttctttgggtacctctcaacaggtgtgtttcttaatcactgtttcctaaattggaatttgtgtgtgtgagtttgcaaatcttctccacggactcaccgtcgtcatggcatttgtgattcagaggagggatctgcggtgccgattccacaggagctcaggctcgcctgtatttctctttcaagcaatgattttcataagtgctttcccctgtaatctcatagttttgtcatttgtaggcagtagggacgtgagctgacatgtgttaggtcacaactttattaattttcaagtgatattaatttttaggtttgaagaagatgctttccccttttctaagttgtctctgtttcctccagcataattttttttcctttggttaatttagattattctctgtcatactggaggtatgtggtgattttattgtttgtcatatttaagaatgaagagaagctgcccatcactgcgtgtctgtgacaggaggcgttggctagagggccttgctcgatgggaagtagggggcgctggctgctgcgctggggactcatggatgcccccatgccgaggtctttatttctctgggctctaaatgactacaccagctgcctttaattttccccagatatgtcagtaactctctttagaggaaaaaaacccaccaccagcctgagtgctttccggcaggggggcggtggtggaggatcattgcagaacacctggcttcaggcacacaggtgagacgccggctgtcctgatggcaggtcttcaggtaatctgtgccttccagcccgcaccactccaggcttgggcatgggggctgccttccacttcccttctctgcatgtgctctggacactttcagttcctcttttttaacaaaagttggccaaagtcagttttgcgtaccttatactttatttatagtaagctgtaagaacccatacttgtgaaggttttcaaaacattagaatatctgctccctggtgttaagaaatgtgtaatatagttgaagcacatatattcattctttctctctctttttctcccccgcccccccgccacactcactccaccaccaccacaatgaccaaggagaagtgcatttttcatttagcagaaatgctgccatttccactgtctatagcagaaggggagttcgtccaaaacatacagtagaaacccctttaattggaatccacagaacggccatccccaaagccccgctggggagaatgaagccactgtgagaggttaagagggtgggggggcagggctggcccttggagtgggctggcgagctgacttgccaaccagaaaggaaataggtcacgggagaaatggggggaaacacaggcccatggaggatgaggtccacgcctgccagtgggtgctgggagggcagccccagggggagcaggcagcaggagatgcccagcccggccccgtgtacctggcaggcctcagcctgtggacaccctcgcctttggtttgtgtgacatttcacagttggtgggacatttgtgccgtttcatccatctttagtctgcgcagctgagctgaatgtggccgccaaagcttttgctgcttctctgtgcccatgcaccatccctttctgtggtttgcacggggagataaaggtcttttttgttggcacctttcgtaactccgagtcctagaatttggaggcttcagtaaaaagaaaagtgatttctctgcataaaaaatttaagaacccttaccgctgatgaccttaaatgaatttcacagacacgtgtcattagcacaggcagcttccagggtgcaactgaagttcccctttcttcacaaatgcttcccccagcctgaaatcttccttggctgaccacatacggcaatctcctacacagcggccttgacaatcatgtgttgtcttgtagcctctcttctactgtcataagcttactttacatttgttatgtaaacctgtcaagaatgcctcacgttaaattgatgctcaggaaggatctatagatttggcttgataaatacatatttgaataaactacctttagttgtcttctttagatgtatccatgatgcattaaatatatttgatcttcaattgatttgtatgaaatgtgagaagaaacaaagaaaacttgattagccataattcatgaaaacgatacactgtttgcagttgtcataaaactgggagctttcccaaaaattcttagagtttaaccttttttttgtttctaatttcatctattttaaagtattgtctgaaattgcttgatattctggaccacagatgatggccagcaccatgggttgcagactggggcactgtgatcccagcaggacccatctgcctggccctgcttgctgtcgcgggaacacctctgccgccaccacggaggccgaggggctcgccccgccccgacgcggaggcagatgtctttcacaaaggatcctggtggcacagggcagtggagtttctggctgaaggtggagcctcatgagaggagaggggcaagtgggaagtaagtgctttcactgaacactgaggtcagaaacacggaagaggtgttcattctcacccatcctctccagcatcacacgataagtccgtctgcgcagaaggcaagggcaggaaacaggcatagagatcagaaaagaagttaggccatcttttcttgaagtgatcacctgtgttgaagtgtcagctgttaagtatcacagtgggatttacaggatactccctccagcagcagccaatacacacacttttccagcgtccatgcggcattcatcaaggtcggtcacatcctgggtcataaaataaacctcaacaagttttaaacagcacagcgtgtgttctttaaccacaagagaatcagctacacgtcaataaacacgagaaaaaactgtgaaaaaaattaaacaacgtatttctaaataatgggtcagaagcctcaagggaaattaaaaaaaaatacatagagttagatgaaaatgaatatacaacatatctgtatttataggatgcagataaatcagtattgaaagagaaatttatagcactaaaatcttatgttagaaaagaggaaagatgacaaattattgatataaattcctacttcaagaaattggaagagtaaaataaactgaaagcagtcagaagaaaggaaataataacagaaatcattaaaattgaaaacagaaaaacaatggagaaatattaaaagctgattctcagaaaaaaaatcaataaaatggatacattcctagcaatactaacaaaatagaaaaatcaagagggagatggaaaaacctctacagatcctgcagccatttaaataataatgaacaactttacactcttaaattcagcaactgagaggaaatggaccaattcctcgaaaacccccagctaccaaaatccaaccaattgaatattctgagtattatctgttcagcaatagataatctgaatagtcatagaatcatgaaagaaattgaatttgtcatttaaaattgtctgaaacataaatctgcaggcatacatggtttcactggagactattgccaaatatttaaaaagaagaagcagaacaccggttttgtacaagctcttccagaagatagaagggttgggaacacatttcaactcattttatgaggccattattatcctaatgccaaaaccagacacaccgttcaaaaaaaataaaaaacagcaaaccaatatctgtcacaaacttagatgccaaaatcctcaaaacaataatagcaaatcagttctagcaatttataaaaggaattatacgctgtgacttagtgagtttttttacgggtgtagaagtctagttcaatgtttaaaaattaattaatgtacttcataccaacagactaaagatgaaaaatcatacgattttaccaattgatgcagaaaactctttcatgcgagagaaaacaaacaaaaaaaaaactttcagtgaactaagaatagagaagaacttcaatttgattttttaaaaaatctgtaaaaacctaacagccgtccttttacttactggtaaaagactgaatgtttcccccttaagattggaagcaaggcaaggatatccattcttatcactgttattcaacagaagtactggaagttctagccagtgcaataagacaagaaaaagacatcattggttatcagggaaacgcaaatcaaaactacagtgaggtgctacctcgcgccactagggtggcagcaataaaacagatgggtaataacaagtgttgacgaggatgtggagagattggaatccttgcacactgctggtgggaatgtaaaatggtacggctgcttcagaagatagtctggcaaggttctcaagatgtgaaactgagggtctccccgtgacccagcaggagagtggcatgcactctagaatagcgcttggcccacactgggcactcagctgacccctgctggcttggctaatgagcagagtaaaaacactcctccctggcagtgtgggggccttccgagtggagggtggtgctggtgtgggggccctccaggtggagggcagtgcaggaggccatggcaggcagtggcagtgcttggactaaggtggtagatgttggcaaggcaattgtttgcatctggggttcgttgtgaaggaagagtgattcgctctggatcagatggaggacttaggcaaaaggagttaaaggcaacaccagtgttttggcctgggtggaatggagcagctgtctcccgagccaggaggaccatgaggctggagggtggatggaggtcttggggtgcaggacacaagagctctgctcaggcaatgtggggtgtggggtcctatcagagatgtttgttcagcatctcctgtaaattaggaagggtgacagggcatacagcagcacgcaagtggacaaaccctggctctactttcctgagaatgcatcagaaggtggtcggtgtcatcctagaacagacaatggctgaagccacgggatggtgacgagcccccatgtggttcgtgtggctggagaggagaggccagtcgaggcctgcgttcggtggtgtgtgtagagtctgggaaaaggagaggcactgacagaccagaccagagaagtagccaggcagttggagggtaaccaggcactcgtggcatcaggaagtcaggaaaagcctcaggaaagccttctagaagtagggacagttagctgattgctgtgctgttgagcggctcacacgaggaggactgaggatggaccgttgtatttgtgcacacggggccattgctggatttaacaaaagcagtgtcaacgcagggtggtgggctctcatgtgattctaaactgttcaagagagggtgggcgatgccatgtggaagctcctgagggaggtttgttttcgtcacatggacattatgagagcatgtgtttgtgctaatgggagtaacctggcagagagggaaaagctgatgtgtgggagggagagagagctcctgagggcggcccttaagtaggtgtgaagggaacaggatccattacacaaggggaggagctggctggaggcggagcatcgacggtggtcattccagaaggggatggcagcacatgcatgcagaggccaggtttggaggaaggatgcagacgcacagcacaatcaagtttaggaggagcaggtacacacacacacacacgtatataagcacatgcacatacagacatgtacacatacacatgcacatagacaacacatgcacacatgtacacgtatactcacctacatttacatacatgtatgcacacacatagacatatatgcatatagacatgcatagatgccacacacatacacacgcacatatacatacatgtccacacatataaacacatgcacatacacatacagccatatacacagagacacacatagacaccatagacacacccacacacatacacatgcatgtgcgcacacatacatgcacatatagacacgcacatgtatacatgtgcatacacacatgcacacgcctatatacacatatatacatgcccacctatacatacataaacatacacatatacatgtgcacacagaaacatggacatatacacacatgcacacatacacacaggtacatgctcatacatgcacatctacacactcacctatacacacacacacacacagcttttggtgccatgccgcagcacattcctagtgcttcacatatgttcctttctaattggtgtttgttttagaaggtggagtgagtacacgtgtctggatccagccttattagattgtctttgcgcactgggaataacacccactttatgctcagctcttactagtgtctccagctttccctctcctccttgttaacagaattggaacccttcctgtcttcccgtctctctcctgaaattagccaaggctctctctcttatgactcagttcattagagaagtaagcagaaacacagcagctgatgatgaacaaaatgtttccgggggtgaaggcacccatctggcagggggcagggcgctcttgcaggttccgccgtgcagagaagaagccacaaggaccgagggaggcctgaaggagatgtctaacctgagccgtagaacgtaagaagttgccagcataaagacaggtaggaaaggcatgtcagtgacagaggcaggagaacacgtgacccacttgtgtggggagctccagcagcgcgttcggagtgctgggcattgccaggtctgaaagaggtcatcagttcttgggaaaggtgcctgcgtgggctagaaatcatggaacaaatcataaagccaagtagtaatttaaacccagatgctactttaattaactcactttgctactttgccctcggcagcaagggttgagggcacagccctggctactagcacagccctggctactagcactgtcctggctacgagcacagccctggctactagcagagccctggctactagcactctcctggttactagcagagccctggctactagcacagccctggctactagcagagccctggctactagcacagccctggttactagcagagccctggctactagcacagccctggctactagcactgtcctggttacgagcacagccctggttactagcagagccctggttactagcacagccctggctactagcacagccctggctactagcactgtcctggttatgagcacagccctggttactagcacagccctggttactagcacagccctggttactagcacagccctggctactagcactgtcctggttacgagcacagccctggttactagcacagccctggttactagcacagccctggctactagcactatcctggttactagcacagccctggttactagcactatcctggctactagcacagccctggttactagcactgtcctggctactagcacagccctggttactagcactgtcctggctactagcacagccctggttactagcactgtcctggctactagcacagccctggttactagcacagccctggctactagcacagccctggctactagcactgtcctggttacgagcacagccctggttacgagcactgtcctggctactagcacagccctggctactagcacagccctggctactagcactgtcctggttactagcacagccctggttactagcacagccctggctactagcactgtcctggttacgagcacagccctggctactagcacagccctggctactagcactgtcctggttacgagcacagccctggctactagcactgtcctggttactagcacagccctggttactagcagagccctggctactagcactctcctggttacgagcacagccctggctactagcacagccctggctactagcactgtcctggctactagcactgtcctggctactagcactgtcctggctactagcactgtcctggctactagcactgtcctggctactagcacagccctggctactagcactgtcctggctactagcacagccctggttactagcactgtcctggctactagcactgtcctggttacgagcacagccctggctactagcactgtcctggctactagcacagccctggttactagcagagccctggttactagcagagccctggcttctagcagagccctggttactagcacagccttggttactagcacagtcctggctactagacacctctgctagagactgcccaaagaatatgccatgagttagctctttctccccctcctgccactggtcagctaagccttccccctaaaaatcactttttgatatagagggtgaagaatttccagtatctcctttagttgactgtgagagaaattagtgtaatttctaattgaccatcttcacagagttgtagaatgatcacagagcatttagaagctgtgggttgctaatagctaaatggctttgaaataatgaatgcttcatttgggggaactcggggtaactgtgacaaaccgttgttatgaaggggctttagctagccttggaagggcaggctggaggcttctgcacgtccttggaagtctccatccaccagaaggagctccttctgctctctcagcctggatgtgatagttgccagcaataggcgcaacttggtttttaaattaaaatctaatatttgatatacataattctatcaacaatatattaaaaatatgatttctgctttgcatctgctctttttggtacactgtgtgtcacatgatagatgccacattaatatctttgactattaatagagttggataagtaatacactgactcctttagcagcctcagcctttctttgaactttgcaaacatggccattgtaattaggtgttgttgaattgagaataaaagttactttaaggcagagctaaaagtgttaccgaggagatgctattttcagaaattacttggtaaagactcctctggagttgttagtaccgtatctcattataaagatgcctcttatatgtatttgagaagggaaagaaggagcccagtgttgacgttttatttagaaaatgtgaggccgggcgcggtggctcacgcctgtaatcccagcactttgggaggccaaggcgggtggatcacctgaggttgggagtttgagactagcctggccaacattggtgaaacccagtctctactaaaaatataaaattatccagacgtggtggcgcatacctgtaatcccagctacttgagaggctgaggcgggagaatcgcttgaacccaggaggtggaggttgcagtgagctgagatggtgccattgccctccagcctgggtgacaagagcaaacctccatctcaaaaaaaaaaaaaaaagtgcagtgcaggtgatccccaccgcccccacagcggtgctttctgcgggtgatccccaccgcccccacagcggtgctttctgcgggtgatccccaccgcccccacagcggtgctttctgcgggtgatccccaccgcccccacagcggtgctttctgcgggtgatccccaccgcccccacagcggtgctttctgcagggagcggacggcaggcctggggcgtgctgcccgcttacctcatgaactgcgcgtgcactgactccacattacccacacgtgggaacaatgcagcagatgtcttttttggatccggttgctgtgtatcgcatcgcaagacttttctggatccttcccaaatcctccagaagactctggagagcattggaagatgagagtctttcttgtgtttgagtccctaggctccccggagaaacccctttgggtgcacgctcaccttaggcttgctgtttgggaaaaccatggctctgggctggaattggtcacttttaggcctgggcactgttcacaagcttggccaatcacaagcactcagccttacacgcaggcctgtttctgaaagatagtttcaattacggggtcaatatcttaggtagatgcaaaaccaaaacagtgtataggaaataactcatctgttgaaatagtttttttttttcccttgggttagcaatcctgaagaacgttcattggcagaaccctttggcttgaatgtcaggatgttttttaaaaatgctaggttctgggtgggtgcggtgggtcaggcctgtaaccccagaacttcgggaggccgaggcaggcagctcacttgaggtcaggaattcgagaccagcctggccaacacggtgaaaccctgtctctactaaaatacaaaaattcgctgggtgtggtggcactcgcctgtgatcccagctactcaggaggctgagggaggtgaatcgcttgaacctggaggtggaggttgcagtgagccaagattgcgccactgcacgccagcctaggcgacaaagcaagactccctctcaaaaacaaaaacaaaacaaaacaaaacctgttggttctaatacccctaaagcaaagagctctcctgtgtactcgtccatgcacccagtagtgtggtgggaaagaaggaattcagcatgcttcctcctgggcctggcagacaggtaccaggtgagtggagcactgtcattgcctgtcacttgctgttggaacctctgcagccagagggcatgtcttcttgtctatacatcaacgtactttggggggcttcttaaataggtggggtttctgtcaatgatcacactgaatggggaaatgaagtttctagtaggcatatttgggataaagctctttctacatctacctgtccgactgctccctcggcaaccacagaatgcttccagtgtccagtgtgctccaggaggcattgggccaagcgcccgtgcatctcagggtgcaggctgagataggcacggcagatgcaaacccagcagcgtctggaccacgggagctttgtctctccaccggacaagacacagacttcttggtccctaaggaagtccccttcaaacctgctgagttctcatgtggctcctgtacactggagactcgccccaccaccccatgccatcctatgttctagtgctgacttggaagaaaggtgggttggtatgaaaagtgttagatttcagaagcttggcacaaatggttggcagcgatggagggactgcagtgtttagaggccatggtgggaggacctgttggatggagggactgcagtgtttggaggccgtggcgggaggacctgttgggtggatggagggactgcggtgtgtgtttagaggccgtggcgggaggacctgttgggtggatggagggactgcggtgtgtgtttagaggccgtggcgggaggacctgttgggtggatggagggactgcggtgtgtgtttagaggccgtggcgtgaggacctgttgggtggatggaggggctgcggtgtgtgtttggaggccgtggcgggagggcctgttgggtggatggaggggctgcggtgtgtgtttggaggccgtggcgggagggcctgttgggtggatgggggggctgcggtgtgtgtttggaggccgtggcgggagggcctgttgggtggatgggggggctgcggtgtgtgtttggaggccgtggcgggagggcctgttgggtggatgggggggctgcggtgtgtgtttggaggccgtggcgggagggcctgttgggtggatgggggggctgcggtgtgtgtttggaagccttggcgggagggcctgttggatggagggactgcggtgtgtgtttagaggccatggcgggaggacctgttgggtggatggaggggctgcggtgtgtgtttggaggccgtggcgggaggacctgttggatggagggactgtggtgtgtgtttagaggccgtggcgagaggacctgttgggtggatggagggactgcggtgtgtgtttagaggctgtggcgggaggacctgttgggtggatggaggggctgcggtgtgtgtttggaggccgtggcgggaggacctgttgggtggatggaggggctgcggtgtgtgtttagaggccgtggcgggaggacctgttgggtggatggaggggctgcggtgtgtgtttggaggccgtggcgggaggacctgttgggtggatggaggggctgcggtgtgtgtttggaggccgtggcgggagggcctgttgggtggatggaggggctgcggtgtgtgtttggaggccgtggcgggagggcctgttgggtggatggaggggctgcggtgtgtgtttggaggccgtggcgggaggacctgttggatggagggactgcggtgtgtgtttagaggccgtggcaagaggacctgttgggtggatggaggggctgcggtgtgtgtttggaggccgtggcgggagggcctgttgggtggatggaggggctgcggtgtgtgtttggaggccgtggcgggaggacctgttggatggagggactgcggtgtgagtttagaggccgtggcaggaggacctgttgggtggatggaggggctgcggtgtgtgtttggaggctgtggcgggagggcctgttgggtggatggaggggctgcggtgtgtgtttggaggccgtggcgggaggacctgttggatggagggactgcggtgtgtgtttagacgccgtggcgggaggacctgttgggtggatggaggggctgcggggtgtgtttagaggccgtggcgggaggacctgttgggtggatggaggggctgcggtgtgtgtttggaggccgtggcgggaggacctgttgggtggatggaggggctgcggtgtgtgtttggaggctgtggcgggaggacctgttgggtggatggaggggctgcggtgtgtgtttggaggctgtggcgggagagcctgctgctcagttctcaggactggttagaaagtaaatttaacgtaggagcaacttaacaaaaagaaaagcttttcattttgggggctttttttgtttgtctttagagatggctttgctctgtcacccaggctggagtgcagtggtgccaccacagctcactgccaccttgaactcctgagcccaagggatcctcccacctcggcctcctgagtagctgggactgcaggcatgcaccactacaccaggctgattttaaacaactttttgtagagacaggggtcttgccatattgcccaggctggtctcaaactccagagctcaagcaatcctcacacctcagcctcttgagaagccaggactacaggcatgcaccaccacacctggctaattaaaaaaaaattttggagtgatggggtctttccatcttgcccaggctgatcttgaactcctgggttcaagtgatcctcccacctcagcctcccaaagtgctggtattacagatgtgagccaccacacctggttatataaaaagaaaacctaaaactagtaaaccacactgatattttttgctatatttctgctatatacatgtccttttgaaaaggaaaataggaatattgaacttagtttttgcgtaaagggccatttcctcccacttaaagttgtttcctttttaatcctctgccagccattcttacgtggccagtggtagtggtgctgattaaaataacacaagtctgccagcagtcccagacagacatcgcaaatggcgccttccacagttcaggactgtgtgcttcactccacggaggtctgcctcagatgcctccctcccagcccctttccggaggccagggagagtgcgtttccaccaagcgcaggagtcagcacttcctcatagccttcccgtgccctcccagcaccaggcacacatggccgctcccacctatcccatccacctgttgtgacgcgggtctgagtagctgcaggtccacgtcgttcctggacccatcatctggcttagtgggcctgtcacagcagacctggaaactaattttctgtgtacagcaggttgcattgccgatgctattttagcttatggagcccagagcccaggaaatggttttaaacatgattttgccttccctcttccctcttgtttaaaaaaacccactccttggtggttcttggtgattgttgcgtggcatgtaaatatccctaatgtcaccgaactgtacatttgaaacagttaacatggcaaattttatgctacaggtaatttatcatcataaaaaaaacctcattcctctagaaattgcagtttttattgaaaaagttaaattatatttattattaagtatatgagaatttgatttgtactctgggtttaatgttcctgtggtagaatgggttattaataaaactagcagtcattagtaccttccagctgagaaatttgagatgttaaaaacaaagtttgtcagagtcagatgacagtgcgttctgtaccatcaccgtggtgcgaggtggctgtgagtgaatacagctctgtgtgtatttcattccgaaagcactgggcgtgctgtctggagagggctcggcagctttcgtgttggcgtcgtaggtgcttggtggagattcagaaggacccagatgggataatggggcaaaagcagccctaaaatcaggggcagtgcccggcactctggacgcatgtgctggcccagctgcagggcagtccgtgtcatctttggggactctgtgtcctcgtcgtcacagctcttttaacatggagctgaaacctcatggggttggtaaaaagcagatgaaatagtatatgtgaagagccgtgagaaatactaagaactacgcaactaaaagtaaggagcaaggaaggagcaaaaatgcagacacagacacattctctccccgtcaagccggggagcgcatcgcagccctcggtgattaaaagccacacactctggacacatctcacccccacccatattcatcgtcacttacaatattcatttacaatagcgcctcctcttcatggaggcctgccacagtctgagtaaacaaaagtgatcttgtccctgtggtattcacaaaacaagccctaggaattgtgtaagtcacaaacagcgtccaggccctggatctgggacgaccagtctctgtcatgcgatgctccagccctcatgctgaccgcttggtccacgaccccgcattagcaggtggcgctctcagtctgaagcctcattctgtaccttgttgttccacatccccagcctagatgggcagatgaggttggcccctacagcagaatgctttccattacagccgaattataggtatttgtagacacgtgaatgaaggagttctgcaagctgtgtggcccggtatgatcggcatttttggggttttctgttttcattcctttagctatctacatgacatgcccaggcatcacatttcagggtaactgaagagaaggcaatgcagattccatctcacagcctgtggtgtgttcttcttgttttgtctgttccctgtctctttctgtccctttgtttcctgctaccctttcccctctcccctctccccacaacaaaggaccagccttgatgatagtgcaggagggactttgcaagccaagctctcccagggcccatggggcctcccttccagcaggtgggccctgcatgcagcccacagtgtctgaggactctgcatccccggaagggaggcattgcttgtgcgcagctgctgtgcctcccccagctgaaagcattctgtttggtggaactggttctgatattttccagctcttctcaattatttccaggagcaggcagagcagtgtgtgtacataatccctcatgtgttatacttattaaattttactggccaaaatgccaggaattcttgtgaacttcattatttctgaaaacgacagcaaaacctcttgtggattaccgaaatggccacatgcaggcaacgtaggtagccagggaaaggaatcacaatctcagtgctagtataattagtccttggtggtataaggatcctgttttgttgaatgctgtggttttttggtaaaacaggaacccacctggtatccatggcagggtatagcaaactcgtgtatcagacagtcctgtcattttttaaacctttgaatgtaatgcattatttaaaaagaaggaagagttacactttcagttagatttcatttggtaaaaagtgaaattttctgtgcattttagtagtaaacaacaattcacttagtgcctttcttcctaaaatggcactgtgatatcagcttcacatatgatacttttacgtgacaagtctcattgaaataaataccaaccggcattactatccctactttaaagagagattaaattttgaattcaaaaacacctcacctttctccctgattacaaaattaatgcacatttgtttgtagaacatttagagaaatccgatgaagatgggaggagataaaatccccctaatcccccactcggggatgagtgctcgctctgtctgtttttcagtctcttttgatgggtcgctttagtcagcccactcaaactcacattttgtggtttgcctttgtgttggtgatggagttcacatcatataacctgaacgtcttcccatgtcattaaacacaacaaaataaggttaggatagattaagattgaacgtttaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgtgcgcctgtagtcccagctactcgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaagattgaacgtttaaaacaaaccgtaagacaccatgaaagacctggtggacagtgatacaatcctggggtaagtagggtcctgcaaagaggaaaaccgggaagaaaacagagttgacagagacacaaccaggctgtgccatcagaagggccttgggaatgagacggccaggtttccaggcttacagtctgtctctggagacagttcagcagcgacgcctctctccagaggactttccagtgaaaactcacagcctgagttgatttattctttccttctgtgttacagctgcagcttactatttggttgtgaccagcagctaaatcacactctcttttcccgaatgttctgcccttcaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggtgagtggcccctgctgtgcccctgggacccactcaactgggctctcccgcagggaccccaacccatgtgggccccaggcattcacctggtcccaggagcccacgtgacagacatgagtgtccccgccttctttttgtgtcattcgggattccaggtggaggtttgggttctactctttgagagctcaagatccttcttccttctgatctgttcgtgggcagctcactgctttgcgatttccaagaacaccctctccttacctttgttcactgcggaggcgtcttagtaccaggataggtcatactggaaactggactttctttcaggggaagaaaaggctgttatgaaaaaggaagtcatttaattccttgcttgagttgaagcgtaatctttcaatgtatttttagcaatgaaaaaagagccatgatttttctgtctccatcctttttaagttatagccgtcgggaacataactgaagaaatgtgtgtgatattccaagatggtagaagccgcatttcagccccaacatccccagcagaacgcacagtgggatatgtgtgtttcctgcctccaaatccaatattctcccctagaccatcttgccagtctttaatatctcctttcccattttatgttttgctgaaaagcttatatgtcgtggctgttaccggctagtagataaatacctctcccttgaggtgccgtgcgaatggtgcagctgtgcagcagacaccgtgctgtcggccgaggacactcttgaggcttctgtcaagatggcctaacactctagacaagtctcctgccttctcacccacagccctgggcggacacggggagctaacagcacagcaaagtaagggcccccagggacaccctgggaggggccagaggggcagggcagcctgaggggggaggaaaacttggccttcctgctctgcctctgcagccaagtccaaattgatcccagaccccagggctgggggttcatgatgttggggtgactgcagcgcagccctcacattaactgtccctaggcctccccaccaaacttgagggctacaggtttccattcagggagagacctccttttagtgttactcaccccaaaatagttggagatgaagggaagagggctgggtgtggtagctcacacctgtaatcctagcactttaggaggctgaggcaggaggatcccttgagcgcgggagttttgagaccagcctgggcaacatagggagaccttgtctctaaaaagaaaatagaaaaatagcaagtgcagtggctcatgcctgtaaccctaatgctttgggaaggtgaggcaggcagattgcttgaggccaggagttcgagactagcctggccaacatggcgaaaccctgtctatactaaaaatacaaaaaaattagctggatgtggtagcacatgcctatattcccagccacttaggaggctgaggtactagaattgctcgaacctgggaggcagaggttgcagtgagccaagattgtgccagtgtactccagcctgggtgacggagcaagaccctgtctcaaaaaaaaaaaaaaaaaaaagaaacaaaaaaagaggggagaggagctgtctggagggggcagcagagagggatctgcagtgtttctgctgtccagccagtacccccaccttacctggctgatgcagacttagcctgaaagggccactgtcctctgcacccagcggagcagagctcacttggcaaaactagacacctgagtagcacagccactacgcagagagaaagctgaaccagggttattgtaaaacaagtgtaatacatacaatcaaagaaataaaggaagacacctgtaacaagatgtgagaacaatgctacagttttaatgccttcccccaaatgtatgtgctggaaacttaatcccccacgcaacagtgttgggaggtgattgcatcatgagggctctgccctcacatttaggttaatgtcactgtcacaggggtaggttagttatgtgagagcaggttgtgataaaagcaagcccagccccttgtgttatcttgcccttccaccttctgccatgggatggcacagcaagaaggtccttgccagatgccactctttgaccttggacctcccagtctccagaactgtaagaaagaagtttctttacttagatgaagagaagctgcttgaaaagtccaagaatacagttaagtaggaggaataagttatagtattccatagtagagtagggagattacggttaacagaaataatttattggatatttcaaaatagcttggagagaagaattgtaatggccccaacacaaaagatagaaggtggagtgagatggtggaatagaagcctccaccagtcttcctgcagcaaggataccaatgtaacaactatcagcacacacagaaagcaccttcatacgaaccaaaaattaggtgagcgctcatagtacccagtttagcttcatgttgctgaaagaggcactgagaggtagaaaaaacagtcttgaaaagataaatgtttgaggtgatgtatgagttggatagatcccagttaccctgatttgatcattacgcattgtatgcacggatcaaaatatcacatggagccccaaaatacatacaactatcatatatcaatttaaagaatacaaaaaaaatttgttataaattactcagtctgtcgtagtctattatagcaacacaaaacagacagacagacaagaaaaagtactataaaagaagaacaaagcagaaataggggtaggtgcactgtaatgtttgaaataaagaacacagtagacaggacccatagcaggagagacactgctggagccaaatgaatggcctggaagactacagtgggggctcacaggaggccatgggaaagggtcgagatgggaaacagaaaagccaggagatgcagagaagggaaatagaggccccagtatgcagactgggggcatcccgtgttgagagaacaagaatatggcagagctgaaaatacctgaagatctcggaaatgcactccccaaaattgggaaagctggaagccctccaactgagagggcttgtgccaaccagaaattaatgggagacctccgacctcagcacatccagtgaggcggaagaccctcttgagggcaccttccctgacgccacgttgtttctgaactgctctccatccttgtttgtttgctctgtaatgtcgaagtcctttctgaacgcagatctcttttcacgtaccagtttatgaggcacacgttacagtgtgcctacctctatttctgcttgtttctcctttcgcattactttctcttgtttgtcttaatctgttttgggttactataacagaatacaacagactgggtaatttaaaatgacaattttttgtattctgtaaattgatatatcatagttgtccatatttggggggtccatgcaatattttgatacctgtatacgatgcattaatgatcaaattggggtaactgggatatccatcacctgaaacatttatcttttctttttaagactgctgaagagacggtcttttggggcctctgtttctcttctctgcatctcctggcttttctgtttcccacctctgtcctttcccacggcctcctatgcgcccctcattgtagtcttccaggatattgtagggcttcagcagcctctcacctttatgagtgttctttttaactctctgtactgtatgtctgatccctgtccaaagaggcttatgagtgcccatttcacgttaccccaggaagagattggtccacctgactcaggagttcatccattcattgcccaaaaactaatttattcagtcccgactgtgtatgtaataagacccatgctaatcactataggagatcctaagaagcatattgccctcaacaaatgtctcctctggttgaggagataagatgtggcttgaaaattcatgatttcaatggatgcttcatgcaagatgaaaatctgaacccttcaaggcaatgtgtgatcaaagaccaagtgaccttatggcaccaagggctgttgtgttcccagaggacagagaaccatggctaagggccacagggtttgagaaagctgcttggaggaggtggaacctgagaggaaggtttcgtcaggagtgcggttgagctcagagagtggactgaagtccaagtccattgtggggtgctttgaatgctgcccagaggaccttgacttctcctgggactctggcacaagagagcccctgaagctgtttgggtagaaaaatgacttcatcagaaccgtgttttagaaagaggatccaagtgatgatagggagaccttggtgaccattaggccattatcatatcagtgcggtcttgagctggtaaaagattagggcagaaagatagaaaatcacccaggggcctgtaggctggagcttctgtagacgcacagtggacactgccgagaaacaggcctcatttctcccatgttcccgtccccgctcccggtttcctgcatgactgctttggtgccccctgactccagaatcaacaccacaccagctctgcctttagactctgcccagaggctctgggctggatactgtatttggtgcgaccctctggggcatttttgcaagttttcaggcagatgggtgggggagcagtgaaggaaggaggaaaaaagacaaagcacaaggggaaccggaaatgacatcgctaccttcctgtgccttccctgccgccccactccagctacctgtcactaaacccagtgcacttcatctagttgacgggtttctctcaggcattttgtttttctgccatgagtgggaaggacttggcttccctccgcgcacagctgtgcactcccaaagacgcctgggccagatgtggcagtgcgtcctgtagtcccagctgcttggaaggccgaggcaggaggatcacttgagcccagaagtttgagaccagccctgggaacacagggaaaccccatctgtaaaaaaaagtaaaataaagaagtatgctttcactctgagggctgctggcctcgttatttctaaaatgggtgcctgccctctgagtagggaatgtgctttctctctaccaaggcatgatgtgtcatcccagtagcccctgaaatccttgtaggagttaggacatagtcagatttttaaaagtaagcatttagtaggaagtgcagtgaaaaacaaactgatacagttaccataagagggactttgaaatcaatatgccacagtggcagacagtggtcatcagataaccactgcctggaacaattgagcggtgtctcaggtggcggctcttttacaataaactgctttctcccatattgaagtgctgaaattaggttgaacatgacattttgctaggtgtctatggcctgtgagtggtaatggactatattcattaaagaattatcaagtgaaatgtgtagttttgtgtgagctaagttaaaaaccaccagggtttttttttttaatggaagagtgagatagtttgtcagacagtaattacgtatgtttttagggttttagttttattttttcattttgaaaagtcaatttttctaattaaaaatgaaagatacattcttttcagaaaattactaaaaagttaaaagtagaaaaaaatcatccaagattttaccatctaaggacaactagtgttcactttttgatgtattgcctgttggtcttttttctgtgcatgtacattttgcactgatgtaagtggacagaatttacgatttcatatccttaacccttcgcattatactagagttccctgccctagatcattagagactcttagtaagtatcattttatatttcactatgttgaagttccatgttttatttagccggagcgtagggctttgggatttaggcgccaggagtatgcgggtgggaaggttcagcctggcactctgatgggagtcggcagacctggttctgtgaaggggcagacgcacttgggttaggcttttcgggccacacagtcccaagtctgctgttgcagcacgaaagagccacaggcaatatataaacaaatgagcatggctgtgttccagtcgagctttcttttttcttttttcttttttttttttttgagaccgagtctcactgttgcccaggctggagtgcagtggcgtgatctcggctcactgcaacctccacctcctcggttcaagcgattctcctgcctcagcctcccgagtagctgggattacaggtgcccaccaccacgcctggctaatttttgtatttttagtagagatgagattttaccatgttggccaggctggcatcaaactcctgacctcaggtgatccgcccgcctcagccttccaaagtgctgagattacaggcacgagccaccgcacccagcctcagtcaagctttctttaaggaaacaggcagttggccagatttggcccaggagctatagcttggcacttcctgctccagaaaagggaactaggattgggctgcagatgacggctgtgcgtgtctgccggtctgcaggtgacctggagaagggcgatgctcgggaaggtggattccctccctccctccctttactatgtaaataagagaaacggtttctaagcacgctgccctcattatgctggcacagctgctacagaatgcggtgtgctgggtaaacaacatacagctttgcttcatttggacaaaatgtgtacatgtgtacttggtggcaagcgtatttatgaatcttatttgatgatgaacttgttggaagacattgttctctaattttttttcatttttgcctgtctttttcatttttggaaactgatttcaataattccaaaatgagcaatgacattactttccacataaatgattatcttactcaccatatacatcaatacactgtaagaatccaaaatatattttttcccttggctgttttctacttctttgattgagtggcataatatcattttagatttattacgcgtctatttgtatactactgaaaattataacccagtgggacttcatttgctgtgggacttgctataaaacagattgatgtctattgcactgtgctgcatgcactagtattgtctattaatgaaaatgataaacattattttggattgaatagaggtcaaaaaacttacttcctttctttcaattaagttgaaggatttccaggactataaatgttaatgatagagcattaacgtgtatttgtcagcgtggaaagtttcgctcctgcattgcccgcaggagacggaagatgcatgggtttcctggcgcgcaggttgggtggaggctcagcgtggctctgtctggccaggctaagtggtttgcagtgcctgtctcatttcagacatttgctgtgacatttgcttcgtattttttcctgatgactcaaccaagaatcattcagaattacctttagaaacataaattcttgtggttttgatgatagagttaaccatgtgttctccaaggagtcttctaaaatacatctgctttgccagagaacacactttcttctgcccgttcagtgctctcgggtcttttgccgcttcctttcaacaacagtccgatgactttgtcttcctgcatatgtgcgaagggagaggagctcactggtcctcccagagggtgaagtaaccgggacacattattgaataaaatgctcttttgtagtatcccactctgtatcttagaccttagtcgtaggcaagtttaatttggaatttgcgtctggagaaacggctttatgacgtttccaagtagagcctcagtatcatggatctcacacagtccccgcggcagcttccaggccgtttccagaggaaaatattttttctccccaaacaagacagtgttctctcactgttccagtctcttgacatatactcaattaagatgaatatcataatgtattgtaatagagctcccgttttaaaagatgacgtgtaaaaaccacctgatggatgcggtaagaaagggaattgaagcagatggaggggcacgggctgctgactccccggctgaaccccgtcctcgggtgctgcaggaaagagtgagattgatgatcctggagggagcccactcagcagcacagccggagactttgctggtcccttgagatggctgagtccccactgggggctggggtgaggggtgaggccggaggagacagtggagctggcgagggccccagggtgcaggcaaggctgagggcactcggctctcctcccactgcccttgataggcatggcctgctgtgctgtgtctggggctcagaaagatggaaaataagagggtggaaagaaagagtttgtcctaccgcccttgtgaaaagagaagtaatccaataataaataaaagtgataaaagacaattggaaatatgaagaagaaacaggaagaaagaccagttggaagcattaagtataaaaaatataattggtgaaataattgaagagatggattgaaaagcaacattatggatagagccaagaataaaccaggaagctgagaagcttgtttgaggagttcccaccaaagggatggagctagaaggaaggggagaaacatgagaggcagagacaaagtttaaatatctaggaaataacattttcttctctctaaaaaaaaacgtagaaaaggagaaaagacaggcttagtaaatagaaagtgtgagatacgatggctaaaatgttttgaaataaagttgtaactgtaaacgaattgaattcacctctcaaagggccatgattcttgtgttggttaaaatcatgatacagcagtctcttgtccatgagacacagatttaaagcaaaacgtttaagcctgggcaaaacagcacgaccctgtctctactaaaaatttaaaaattagctggacatggtggcttatgcctgtggtctcagttcctcgggaggctgaggcaggaggatcagttgagcccaggagttcaaggctgcagtgagctgtgattgtgccactgcactccagcctgggtgacagggtaagacccagtctctaaaaaaaaataataataataaaaaataagaacatgtatttcaaaggttggaaatcagaagatgaaaaagagaaatacgagctaaaagaaagctggggtggccagtcccaatatgacttaaagcagaagctgagataaattattgagaggggcaaagaaaaatgttgtattgtggtaaaacgaacaggaaagcaggaaggtatatactgatgatgactgtgtgcacctgacaacgtggcctcgaacgagataagatgggagctgaagtgtggatggaagcagatgaatgagaagtgtgcttagatacagagacaccaagtacagacaaaggaagcaacgtaaatacgacttttgtcaccgaattaattagccagacctcacagaggcacacaggaccatacatccaacagggaatgtggacatatgtggaccattcacaaaaataaatcatgcgcccgactacaaagaaagctttactaatccggaagaatcagcatcgtgtgaactccgtggcagaccacacgcaatgaagctagaactcagtaacgaaaggacagctttaacaaaagtctgaaaactaaaatcttaaaatccttggattaaagaggaaatattttatattttttatttttttttacatgtacacacttacacatttatttgacttcattgtagaactttgacattaatcccaataactaatctctttatacatattgtttcatcctgacatcaacctgaacagggaaaattgacttatataagcacatagctactatagatgtctttttagaaactgattattgatatatagcagagaaacctaaaatctctttaactaacttgaagtcctgaccgtatgacttcttttgttattttattttattttattttattttattttattttattttattttattttattttattattatacttttaagttttagggtacatgtgcacaatgtgcaggttacatatgtatacatgtgacatgctggtgtgctgcacccattaactcgtcatttagcattaggtatatctcctaatgctatccctcccccctccccccaccccacaacaggcccagagtgtgatgttccccttcctgtgtccatgtgttctcattgttcagttcccacctatgagtgagaacatgcagtgtttggttttttgtccttgcaatagtttactgagaatgatgatttccaatttcatccatgtccctacaaaggacatgaactcatcattttttatggccgcatagtattccatggtgtatatgtgccacattttcttaatccagtctatcattgttggacatttgggttggttccaagtctttgctattgtgaatagtgccacagtaaacatacgtgtgcatgtgtctttatagcagcatgatttatagtcctttgagtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaacgattgccattctaactggtgtgagatggtatctcattgtggttttgatttgcatttctaaagaggaaatactttaaaactgataaaatactcacagccaaatgttagtaatagcacatttgctgtttgtggggtgtatgtagccaaagcaggcgaggatttaatacatttagtcagaaaacaaagattaaaaaaacaagaaaaattaaatgtttgccttaaagagccaggggaaaaatgcaataaacagatgaaaaacaaaatgaagagagcgaatctgaaagatacaggcagccctacgctgtccgtcgcatctctgcatccatagggtctctgcttcatttcctgggagtcctgccagtgtgggagggggcgtccagggcctctgaacactcttctcacagattttcatctgggcacttgctctcagttcttcttttcagagagccagttgtctcagttcttgatacttgctgacagcaggctttgggaggtgagtgcttcattttgactttgcaccgtccaggtcaaaggcttcacttctctcacctctgctgagccacttacgcttgtccaactgtttcttaacgtttggttgacattttacagttacagggataacagtagctagcatttgtcgagcgtcactggagccattccactaatgcactcatctaacaccacacgcctgtaaggtttggactggcgttagtgctgctttcaggatgaggaagttcaggttgcttggagagtagctggtggagtcaggattcaaagctgggtgcccaggctcccgaactgacagcctcaactctgttgttccgcctctctctctcctgcccagcgtctctcatttgccatgatttccttcctggggctctccgtccttgtcctgttctttttctctcgttatggaggaagttgagatcactatcatctatagtctgtcacgtctaaatagaggttaccacgacttacttaacgtggtaaaggctacatcagagctcttcagcaaaccagcctagtggggagactggagacgtcttcccttcgaagctgggaacaaggcaaagattctctctcgcactaaaacagtattagaattcctgacccccagtaagataactccataaccagcagaaggaatgtgaacatttgtaattatctgtttacagtaagggccatctaacatagttcactgattctagcatgtactttttaaattttttttaagacgtgatcttgctttgtcacccaggctggagtgcagtggtgtgaacacggcccaccgtagtctcaacttctcgggctcaagcaatccccccacctcagccccccaggtaactgggactacaggtgtatgccaccattctgactaatttttgtatcttttgtagagactgtgtcaccatgttgcccaggctggtctcgaactcctaagctcaagagatcctcccacctcagccttacaaagtgctggaattacaagcatgaggcaccatgtctggtccttttttaaaaaatagagacagggtctctcccttttacttagatgggagtgcagtgacacagtcatagctcactgcatccttgaactcctgggctcaagtgatcctcctgctttagcctcccaaagtgctggaattccaggcatgagccaccacgcctgatcccagcatgtgcgttttcacacttaacatatctggggtccagaagcatcttacaataagtaacatacctgtttagttggcagttcttttcctttgttaatagtgtatagaaatgcttgcaaaggtccacctagaggtgtgcactgtaccctttcttactgctgtttgtaagctcactgtttgtcactagggaaagaaacaggcaccattacttaactaggtgttcatgtaccggcaataattgatctcaaaatttaatgctatttgtagtttttaattaaaaaactctcaaatgtatggtctaagtttttctttaagtccagaaaaaaaagaatacattaaaccctaagtaagtagaagaaaagaaataataaagagaagagcaaaaataaacagaagttgaccccaaaatttgtaaaaattcatgaaactagttgatagtttttgaaaggttcattaaaattgtcaaaactttttctagagtgctcaagaaaaatagaaggaagatacaaatgactttcatcagaaatgaaagagggcacatccttactgatcctacagatgttaaaagaataaggggccaggtgcgggggctcatgcctataatcccagcactttgggaggccgaggcaggtggatcgcttgagcccaggagttcaagaccagcctgggcaacatagcaaaaccccatctctacaaaatataaaaattactcgtgcgtggtggcatacgcttgtagtcccagctacttgggaggctgaggtgggaggatcactgggaggcattgaggctgtagtgagcagtgcagtgatcacgtcactgtggtccagcatagaccacagagtgagaccctgtctccaaaaatgaaaattataagtaaataaaaggagaataagggaatcattttaatcatgaaggaccatatgccagtaaattcttcatcttagatgcaatggataaattctgtgaaagacacaagttatcaaatctgacagaagaataaaaagaaaatttggataggatatatctgttaagtaaattaaatttctggttaacaaccattcaaagacaaccccgcacccagatatctttactagtgaattttaccaaacctttaagatgaacagaatagacagacaacctttgtgaaatgtttaaatatctgctgaccatattaagttgctgtcccaaggctcggtgtaattagtaatggtaaaagctaagaaaatctttacaaggttactgcctaactgttgactaatttgaccaaattttatgcacctggggccttttacaaatcagcttacttccctaagaaaaagtgttacttgaattttttttttatgattttattttattttattatttttgagacagagtcttgctgtgtcgccaggctggagtgcagtggtgcaatctcagctcactgcaacctctgactccctgtttcaagtgattctcctgcctcagccttctgagtagctgggattacaggcacgtaacaccatgcctggctaatttttgtatttttagtagagatggggtttcaccatgttagccaggatggtctcgatttccagacctcgtgatccgcccgcctcggcctcccaaagtgctgggattacaggcgtgagccaccgcgcctgaccacgtgaatttttttttaagagcagcttgcctttatatttttggttcacgttgggacttaccttctagtcatttactgttggctcacatttcctcttctcccatgtctgtctaacgggagaaccatggagtgcgtgatctcacttggggtctcagtaggccgcttagtgagtcccaaagacttttgtgagagtttgaatgcatccgtgtgtaatgtatctggaggactcaagggtagcaagtatacacagagtatccttttaacataaaaggagcattcagaaaagaattaagactgtgcagttcagcccacagttgggctctcatagctactgagttattcatgtaatcctcggaaatcagcttgggtgaaatactgcacgggaaagagtgctcagccccggcctcactcctgcctgtcccaggcctcctcactgtccgtgtctcatgggaagaaagtcatttgttgtctcctgcttgatgtcatcatcactatgttccagattagcttcaggacttgtttgaaatcatacctactaatcgactgacttatatccccatcacacggtgacatattaactgcttatttgcctctttgtatcttcttcttaaacttctgggcattttagtggcagtttggcttcttgtttgatttatgtgcctaagcgtgctcatgcctccatatttaatcagtgacgttaggtcacattgcatgcaaaaactgtcagtgcattcagctccgtatttaatagcaggcattcatgacccttttttaaataaaaaagcgatcatttgatttgtgctaaactggacagtatattgcggaagccattttcatcctcattttacttgtgctgagatcgaatcgataatgcctcttgatggcatcattgttggaacgccagaaccgtgctgtcacatagacctgtatggagggtggcatgtgtcccacgccagagccatgccatcatgtaggcctgtgtggagggtggcatggtgtcccacgccagaaccaagctggcaagtagacccataaggatggtggcatggtgttgccagccttgttgtaaaatggtgtgaattaatccaggagacgttagcctcttctttggtttctcgttatttgtactgctaagtaaatgttgtatatgtatgttcagtacatagaacaatttaaactggattcagaagccatttcagtgcactctgagactgggcattaaaccttgctttaagtactgtcaccacagtcactgagaacagcccgagtgctgcttacttgcaggttgaaaggactctgtgcaatgagaacttctgagttcccatcctgtcccaggtagccagtaaacacctaagtcatgaaggttatgagacacagtccctgtgtgcccggaaaagagggtctccagggagaggtgctccctctcatcagtgctcttcttggagacagaggagggagtagggatactccttctgcttgccttggaggcagaggcggcatcactgctgttggggtgtcctcgtatcacccgctatgatgagtgaaatttcaccagcaagaggaggtggagaaaggcattgtgaggcactcaccctgacctgctcagaggcctgaacgcatctcgaccagcagcccagtgtggcatctgagtgaaggatggtggccaggacacgagagggagggcggggtccgtgaccatgaagctcgagctggaatttcttctgttggcagtgccttctttgtggtaggtgctgtgcagctgcagggctggcctggcctgcagagccagtcacacgggggtctccacccttgtctcagcccactagtgctgctgcacaggcccctgaaacagggtaatttataaagaacagagttatttctcccggttctggaggctggaagtcccaggtcaaggcatcggtgggtttggcgtctggtgagggctgttctctgcattcgaggtggcgtcttttcccgtgtcctcctgggaggactgctgcatcctcacatagcagaaggcagaaggcagcagaggctatgttcctccagcacccccgccttaaataaggttgctaaaatcccactcaggatggcggagccttgggatgtaaccgtcatctaaagcccacctcttagcactgtcacttcgggtcctcagatccaacaggaattttaggagggacgtgccttctcagcgtagcagccctctgggaaatgaaagcctgtttgagaagacatgttcgtatctcagcagcagcgtggtccgggctctcctgaggaaggtgcccagggcatttggggacacagaggagcaaatttcatccagcaggggcagctcactgtgtgggtgaggcttagaactgggcatggcggtggctgtcggatggacatgcaggttcaggatccaggtatgtctgtcacctaccatttctaatggaggacaacgatatcatcagttgtgaacacatcttctctgttactgttcaagaagccatgctgtttgcattctctaagaggaaaatcgcactgctggtagcaccttcaacctgcaattcctacttacccgcctcaaacgcttcctgtcttcacttttgctgtccgcaagatccccaccttccaatccacaaatgtttgtactcaaatttccccagcagaaccagcaataaagcacagaaagcagctgacctaagcccacccacctctttccttaaatcgggcatcttccccttagacagagtgtctggtttgcgctgctgtcaccactcagcttctcccagcatacagcgtgtgctgcctctcctggcccggggcagtcccctgccttcctgccattccagcagctctcccggaaccatcgaggtgatcgctgccttctgagccgtcagcctcactggcctgtccctaatccttgcccctgaagagtccgctgcagagctgaagcaagggacacccccttcagcacctccttccctgccctggggtctgcggctgcctctctgaagctcccactctctggccagcctctcttcctgcacttggacgtatgttctcccacggctgtgttcttggccctcctcttgacgtacttctgcctgtgagaaactgcagctcatccagcgatcactatcctgacccctctgagataatccctccttcctcacgctctccctctgccagcgctttcctcgtcatatacacctgcataaacctctcatgcctgaaacaaaaggtccaccccagcaagagggcactcccgccgcccgctggccctcctgggcctcattgcctagttctttctctccaggtgcagttaagcttcaggacggaagggggtacctcccaagcctttctgcccttcctgtccagccctcaatattgtaatcaggtctcctcaacctagaacgccccctctccttcccagccccaggtgtttaccctggttgtttgtgtttcttgtttttctgtgtaatggaaggaaggtatcacctgagaggccttaggaatgacacaggaaaccctgctgcctccattcagacttgggtggggtgggggtgggtggaggccagctggcatctcccaggatttctgaaccctcgtgtccctcagccagccaccgccatgcccagctccaggcctcgcccccgatatgggggaagctgttgctgctggatctgacgtgcccgtcttctcgctcgggcaccccagctggtgcgtagcgaggcagtcacagctcactgcagcctcgacctcctaggctcaagtgatcctcccacctcagcctccctggtaactgggtctataggtgcacaccaccatgcctggctaatttttcacattttttgtagaaatggggtcttgttatattggccaggctggtctttaacttctggcctcaagcagtcctccaactgcagcctcccaaagtgctgggattacaggcctgacactaatttctgcacatagaggtgaggaggcacctcgggtatcagggtagtgaatgagtgcctggaccacacaggccagagtcgaaatctgttcacctgccttaatctgccactgtttggctgcttttaaaaaataaatgtacatctttgtcttggattgtcttccttaatatcacatccaaaaactcaatactagcaatttttcagaagacctcgatgttttgggcagcccttagacctccctgtcacttgacccaaatggtgctgggttgaccccagtccagcagggaccaccagtgctgtccccaacatgactggttccccctgtctctccccccacatgcctggacccccttcctctccctccacatgcctggacccccttcctctccctccacatgccctgttccccttcccctcccccccacatgcctggtcccccacccctaccctccccgcccttgtctggtcttcagtgcctccctgatgaggggcagctgcccccattctcctgcggcagcttcaccagccacacggctcatccaatggcttggaccttgtttcattcactaaagcaccagctctagcactgtgaggtcattattgagtttgtaagcaaaaatcttcttaaggaacagactaatgtgtatttaattttcattatgtaccaggtacatattaagactttttgtttcttttaatctcagtaattcctgttttatagttccattatcctcatcgtgtaagtgaaaggtaagtggtggcagccggacatcaaggtgtgaactcgcctggggctgtacaggggcagagccagggctacgatttgaaccggggttttctgacctgagcgctcttctcttcattaccttctgcctcctccttctcaccacttaagtggcttcatgcatgcagggcttttaaaatgagattttctcaaagagccgtgtgtctgcaggtggcatgcgctggcactgggctattgggaggcacagagttgttcctgggtctctcccactggagaaagcagtgtgtttggctgagccagtgacacagggctgcccgggagcggcaccaccactcttgggacaggtgggcaggcgctgttgatgtccctggatgttgtcccttcacctgcagtttgtcaccaaagccccgagggactgtggtagagacacagctagtggggacttctctgttcgcacagagactctgcagttgcagctacatcacactctggtaaatagcgcctctggcagtgggttttaatatccacgttggttgttgaagcagtatattctaggggtgcctgggaagacagtcgtttaaaatgtctctgctttttataggtcagtttttcttcttctttctcactcccttgccaattgttggacttaaagtttgttggaaaggcccttcctttattttgatttgtgcctgtgctttgctccaaggcaggccactgggggcattttttacaccgaggacttggttggaaccgttaaccagtggctggctggtctgtttgtttacaaggcagccccgcagccttgttctgagctggctggctcctagatgttatttggatttgcttcctctggcaccaggccctcctccaggcaggcgcttgggcaggctggtgggactgatgggtagccttgctggggacgtgtagtcactgtggcgctgccagcaaactgttctttctggaagaggaacgcttggtgcctgggtgtgttcagtgtgttctgttgtgcatcagagctccctcagacgtcgaccgcttctgattccctccagacagctcccggtggacacgcagggctatgcggcctgccctgggggctatggtgctgaatcctgacaaaggccctcttctcgggctgtcagaaaggacgaggctgagtcaggctttaatgtaaaccatcactccctgtttttctatttcttcgttgaaagaagcactgatcattgtgttcactagaaacacctcaagtttttaaaaggctcctctcctgttggtgtgactcgagggcgctgtgacatcctgagaaagcggggactctgggagtctggatgtcaagctggtcccgtctccacccgccttgagttctcggttctcgacagcgcccgtgtgatgatgatgctcacgctccggtgtgacacagacggcgcgggagctgcacgggagagtgctttggaagtggaagccgcaatgtcatgtaagctgttgagtatgaattgtatcatatttcacaatccacagagtattctcccttatggtgtcacatttgctcttactaataacccaggacttgtcaaagcagacgtagtgcataaaacatcactgtgttactgatgaggtaccagatgctccgcgtgcggccgtctggggtggacagcttcatttatggcagagccaaacaggagcccggatcttctgatcccaaatcccgtattattttcactattccatgctgcctgccttcaccaacgtgagctgaagttattacatgttatcactttacttgatgccgtgccgtactttacacgagaaccagcttcccgttggggactttacagagctttcggcagggacagtaatgggggcggcccctgggaagctgtgcaaagtagcatttgcggcgccacatcccgcagtgtttcctgaggactcgctgtgtgcaggggaccgtaagatgccacagagaaatcaaggaggctgcggacacagtgtctgtcctcaagtcattcatcattccctttctctgcccctctgccgtggaaggttttcaagtaattaagctgcttgcttatatgcagctttcctccacgggccccgcctgtgcgtagtcgtgctctggcagagtctctgcaccttcctccctcgggctcctgggcctgtgtctgtccgtcctccactgtcttgctgtctgcatcttcatggtgtaagtctggcccctcagccgccccacaagcctggcccggggccaggcttccagccgctgcttcaacccaaaggtggaacacctgtttcctgcagtggagaagatgggaaagccttttctgcagggcttttactcccacttccttcttgttttcagccattttctctgtgctgtttttctcctttcttcctgagactttcccctttgacttgttcttagtcttctttctttctcttttgaacaggtagcggtcttgttatgttgcccaggatagtctcaaactcctggcctcaagcgatcctctcgcctcagctttccaaagtactgagactgcaggtgtcagccccatacccagccagtcttctcttttctttactttgagtttaggcttcttgagttgttttcttcttctcagatgcttcagggggtagctgagaatgttgaaaatactaaagtgcagcagaagcaaggaggcagagccagccctggtttcccactgatgatcaaatttctttttagctcagaaatactggcttatgcctaacccatcaaaggtgcagcattgttgggcacaggatgaaaaacagacagcccccacgtttggctgtcaaaccacatgacccagaaatagccatcattgtaagaaccccagagggagcctttgctatcttttaatttattgcacaaataatattataacagtaaacaatgaaaaggaagaaatgaaagaaaaattacccagaatccactgtttttgctattccatattcttcatacatttgtccatatatgcacataattttacttacttggaattaaatatattttgtattgtttttaatttgaagatcactgattttatattgctattgatattttcaaatttagtattccatcacatttatagacagtattacttaatcatttccctctcataaaattatagtgcttgcaaggagttttttcctgttcatctttgcggtacatagaaccttccttagctgtccatggtagcatgcagctgtagtctcagctacgtggaaagctgagatgggagggtcacttgagcccaacagtttaaagttatgatgagctatgattgtgccactgtactctagcctgggcaacatagcatagagtaagatcctgtctcttaaaagaaaaaaataataatattttcttattttggactatttcttagaatatgtttctgggaataagatcagtaggtcaaagtatatagctcttgatatcttttgccaaacttcctttttttttttttttttttgagatggagtctcactctgtcttcccaggctggagtgcagtggcgtgatctcggctcactgcaagttctgcctcctggattcaagcgattctcctgcctcagactcccaagtagctgggactataggtgtgcaccacaatgcccaatactaatttttgtatttttagtagagatggggtttcaccatgctggccgggctggtcttgaactcctgaccttgtgatccgtccgcctcggcctcccaaagtgctgggattacaggtgtgagtcactgtgcccggcgctgccaaacttctttactaaaaggttgctctaattacacggccccaaatcacacatatatgaaagtgtcattttcaacacaacattattttcagagagaaaatgttccttactttgcatattgcaggggaaagactgtattctgcaggtcctgtacgtgactgcaagaaaggaccagtattacaaggccagagacagagaaggccccacagtgacatctggaccgaccagtattacaaggccggagacagagaaggccccacagtgtgacatctggaccaaatctttttggtgaacccaagtgctgagttattgatcaggaagtgaagggggaggccgggcgtggtggctcacgcctgtaatcccagcattttgggaggacgaggtgggcagattacctgaggtcgggagttcaagaccatcctgaccaacatggagaaaccctgtctactaaaaatacaaaaattagctggacgtggtggtgcacacctgtaatcccatctactggggaggctgaggcaggagaatcgcttgaaccagggagtcggaggttgcagtgaaccaagatggcatcattgcactcccagtcttggcaacagagcaagaccctctcaaaaaaaaaaaaagaaaaaagaaagtgaagggggagcggaggccagtgtgggaggaagagacaggaaaggtcatctggatagtaaagatcacctggtttcatgttatttcgaaatttacggataattttagatatgtggttgaaaactattaaaaacttgaatattcaagcaggactagagaaagtgtctctggtatgtcttcattccagccgtcctgctgtgtgtgaagtggtatctcactgttccgctttgcatctccctaacgactaatgacatcaggcatctttttatgggcttattggcctttgttgtttttttttttgagatggagtcctttgaggtgggaaagttttattttattttggtaaagtccatcttatctattttgttgttgctgtcacctgtacttttagtgtcatgtttaagaagccgttgcttaatccaaggttatgaagtttgacgcctgcgccgactccagcacttttatagctttagctgttacgtctaggcctttggtccgttttgagttaatttttgtaaatggtgtgatgaagtcttaaataagcatagcttggacttttggatctatttttaactttgagaatgttttctgcaggaatggcagaaatagatgtattgctggagtgactttggaactgtataaagaaaaggtgaacgccagaggctgaagagggaaggagctctttccctagcaggtttctgtgtagcgagcatccgtggctggggttaaagtgttatttcattatgcagtttatcaaatgggaaaagacaaaacctaagggcatttgtatctactccataccataaaagtttgccattttactttgatcatataacaactctgaaaaatactgtttttcatggattaatcaaattaccaacattactttaaaatcacaccgagtcactctttctgtgccgcaaggtgctaggccagtgacatctctgatcttgggagccgctgttaggagcctgatgttaatgacagataaaaattgatgtcagatagaaaattaacctccttcagggtatgtgaaactgcttcccctaatcctatgttcttccttagcaaaccgaatgcaacccaggagctctgaagaaggaaaatgatcagctgtttatctgcttggcaccctttggaacagtcattttcccatctcatttgaaagcagcagttagaaaaatcacaaagaaatagtctttctaaagttttccttccattttaattcttttgtgtttttcttcatcacattttccatacaccccacacgattaaagaatggtcattctgcgtttcaaggggcccaggcgggaggatcacttgagactaggagtttgagaccagcctgggcaacatagcaacacccagtctgtaccaaactttcttcaaaaaattagcctggtatggtggtgcgcctatggtcccagcttctcgggagaaggaggcaggaggatgactagagcccgggagttcaccactaccgtgagctgagatcatgccactgcactccagcccacacagcagagtggggcaagacctggtctcttaaaagaataaaatattgactgaggatcaggacggtaaaatcacgagacctcagagaaggaacaactgtcgtggcacctcatgtgcggtgtctggccgcggcgcctgcgaatgggttttgctcttggttgtcttggaaccaaacatctgtgtgctggcatggactggacatcgccaggtgtttggaccatatctttgtggtttagcacaaaaccaagacatacagtttgtacctgtcatagtcactggagaagccgtgctgttaattgatacagaaacacagccgtgggctgagatgcaccttctgagcccatggctgtcctcagcctcatcacagaccccaagctgaatggtcctgccggactaggcatgagggctggagctcatgtgtgcgcccgtaagctggctttccattcagtggtttcaacttctgcctgtagaaacaccaaaattgtccatgaggtaaatgaaaatacatcccaggacactctcactgtcctcccattgtctggtgtcttgttgagggctctggccaggtcaacaggcaactgttttgtcctgtgaaagtgtggcgcctccgtggctttctgggagaaccgaagagagagacttgcagtcggcgaggaactccttggcgcaagcagcgtgcggatctcctcatgcttctgccgtgcctacgtgcactgacgtcgtcacaggtgggggataagattccgtcgcggtcggagttttcctgtgtgaacattgagatgtgcaattccgtgaccgcaggcactgcccctccgacacagtggggttcatctgcttgcggaagcctcttaagggcggttgggagagaccctcagtggcgcatgtctggaggctgctgacctagcgtcgcaaccatagaccaggaacacaagcagataaaagcagcaagtgggacagattgaaccagctcttggcatagtttcccaccccccagctagttcaggagtctgtggacaaactgtgtttcaagcatgttgaacaacgcagtgtgcatttccaagttcattggaaaatctatgtgagttcacttgtttgccaccagaatgccaggagtgagctccgttctcggggtgctcttccttagcccccagtttttgcggtggcttaaggctctgcaggagtcgggggtacccaggctccactccttggcccgactccatgctgttgcggctctcatctgctgtgggaaactcgctcctcgtggacattttccacgcctctggctggatttctgctcagtagccttcagccagcggtgttctcatcgtgtccatctgcttctattaagttaatgggcacagacacacggcccataaagcagctggatcaaaagtctggttcttatcagacgacttaattgataaatgtcgcaatcacaagaagctgaaatgctgttgtgcaatgacttccagaatggtgttctgggcacgtcagcttccctaagtacaactggagccgtcggtggagaagagcggaaagggagagttcagttggtaggagggaggggtccagcgagagacagggatgtacacgaagtctgtttaactttacatattgggtgcagaaaccaccacggtttaaatgcttaggaagacaactggatagacggtggtttgtttctagccctgattctgaactcatctgtcctgaaaaacagttgctgacaccctctgaccctcagaggcggtccgggctagaaggggattagtggaggacatctcggcagggctgctgtaggcggatgttgtccagtcagagcggaaccgtgacctgtgatacgtatacttttcatttttgccgtttatgctatttttagattgtctttattttacatattaggaatttgcacacacgtcaggtgagtcgtaagagtcacagaggaagttccttcttagcctgtggcagggtggatcctgcagctcccttcccccctcaccctccccccggggggcctcactcacacagcccctccggctccctttctttttatgagctttcaccttactctgttttcctcttttcttcctgatttccctaattgagtttgagtcagtgcattgagcgtgcgctctcagttgtcaggggtacacacttgtgtgtgattttttatgtggctgagatgcaccaggatcctgttgcctcagcccactgtggtctttgggtgcagaggagggttcttatgcccagccacttagccagcagggtagctgggggtgagtttcagaaccttctgaacctcaactgtctcccctccagggcaggaaggataataacacacatctaagcggggagggtgataattgtgcccatagtctaaatctttctcagatcctccggtgacattgccgggtggcctgagctaggaggaagggtgaggacttaggcagatggaggactgtgcatttcagttttttgttttaattaatttttttaactgacaagataacttagagggattttttaaattggcaaatagaatcttcagctttgccttcggttccctcatcgtagggtcagctcgtggctgccaccccaagacaacacttcctccccgtggccgccctgcggttcccttcttcccggagggtaccaacgagctaggcctggtgctgccgaaaaggaactcaggaaaaggttccaaaatttttaataggaagaatttcccaagtctaaaatacacagaacttactcaaaaagggccccttcttgtggatatttttaagagtacattttgccacgctgtctcgcgtggggcctctgcagcagctgagacgtttggcagtttcttcaagacttggagtaaaacctcgcctgagatagaatctaaatacactgggcttggatcgcccatttgactaaatttcgatcccaactctagctttcagaaacctccttatagggagagacctattgctatgggaaggcaagagaaattaatgtctgcgttattccagcaaagcccctgcactgcgctggagggacttttgtttgcgtctttgggttgcagaaggggctatgattgtgcgtggcttatcttggtctccagcccagtttagacctccttctagctgatctcttctctcacttgtactttggaagagagtcagggcttggctttgggtcaccaggcgtgcagccatgtcagagctctggagccacctcggttttgtccctgtcacggggattgactgattcttaaatgatctgcgcgaggcggccctggagcctacagcagcaccgttcccccagggtatcgctggcctgtgtttcacatagggtcagctcttcgggggttgtcactgagtagtaagtgctgagccctcctgtccctgtttgcagaggcagcggctggtttctggctggccagtgattcctccaccctgtgaacacacgtggaaattgacacggtggactctgggatgtaggggaaggctctgggtcaagggcatggcttctttatatagaaagaacaagtcagatggcaggaaagatataatggtgggtcatttaagtattggttctttgtaatttaaaagaatcactttatttatttatttttttatttttatttttttttaaagaactgagttttatgggtttgccacaaagccattctacatccccgacaagaataagaataggtgaggacccagcagtcgcatgtgaaaataaacggtgtatttagcgggaaactaatgcctcttgcagccatcaggcactgttttcccttgatcctggaacaccttggtttccggggatctcagccccagccgttgccccatagctgttcctcagcaccgcagtcgtggaagccctgtactgaattagaaccgagcagccctggctctcaaggggtcacggggtgagaggaccagagttctgcaggcattttcacgtgagaaactccagtcctctgtggctgtcccacttcctgacagcttggcttccttcaggcagcctgagtattattcccatcttagctctgtcggtatgtagtataaacacagtccatgttattgatagtttcttaggtaaaaacacattaatatttgaatcgggccaaggagcacggagaatctgaagttgtcgcaaacaagctggctgtaaatgggctcctccagggcaaggcacaccccagagctactgggggaggtggaagcttgctgtgtgttgtgtgtgtgtttcctgtggttgatgctcataagcgttacctccgtggaagaggtttacctttttaggaaagagttggttttctgcttttgcaaatttgtaccaactgttgatcatctcaaggacagtggagaagggacaggcaaggagcctccctttcagtcttggcattcttcgaaaatagaaggtggcttccttaaatgatttcccgacttgactcatcaatgtaggaatgcctgtgttgacactctcttccccctctctctctccgtctctgtccccatcccttttactttttattataggacagttttcaaccattctgtggaacagttgagaggatgataaagtgaaccctgtatatattaaatcacctacattttacaattatttgctctgttgttttgtttttgtgggtatgtttgctaaattacagacaacatgatgttttaccacccaaatacttaatcatttcttttttaaaaaactgacatttttcttataaccaaattatcttaactttttaatgtcttttgaacccaaatggcagagcccttgcaattagccttgttcccgtggaaggtgtattccattgccggccaggctcatgcatccagcaggcgcctaaggggctcctccgatatccagccagctctgacaatggggccgtagcccagaacaaggcagatgggattggctcattatgtgggttggcagaaagctccgatgaggtgttcatctgtatttctcttaccaatggaataattgtttttcctttttgctagcttgcttctgtagcacggagggccactatgaaatagcaaactcttgcacttaatttgtatcttgtcctgcttaccggcctagaagctcctaaatagagtaaacttttctgtacattacaaagtgcagctgtttaacgtttgcaagttaggaaagtcgcttctacttggttttcttctaataatactaaaaggcatactttttttttaaggcaaaggatctcactgtcacccaggctagagtgcagtggcacgatcatagctcactgcagccttaacctcctgagctcaaacgatcctcctgcctcagcctcccgagtcctctgaccatgcccagctaacttatttgtggagatggggactcaactgtgctgtccacgctggcctcacactcgtgtcctcaagtgatcctcctgccttgggctcccagagtgctggaattacaggcatgagccaaaaaaaaaaacacatacttttaaatttagttacaaatatcgcatgatttggcacattaatttcatgtggggatgtttagttctttgggttttttttaacctgctggattaaatgaaatgctgagagttgaagaaattggcttattttcctttttcttttctttttttgagatggagtttcactcttgttgcccaggctggagtgcaatggcacgaactcagctcactgcaacctccgccttctgggttcaagcaattctcctgcctcagcctcccgagtagctgggattataggcacccaccaccatgcccagctaattttttgtatttttagtagaaatggggtttcaccttgttggccaggctggtcttgaactcctgacctcaggtgatctgcccacctcagccccccaaagtgctgggattacaggcatgagccactgtgcccggcctattttactttttttttttttttgagacagagtttcgctctttttgccaaggctggagtgcagtggcgcaatctcggctcactgcaacctccgcctcccgagttcaagtgattctcctgcctcagcctcctgagtagctgggattacaggtgtccgccaccacgcctggctaatgctggttttttttgttgttgttgttttgtttgtttatttagtagagacagagtttctccatgttggtcaggctggtctcgaactcccaacctcaggtgatccacccgccttggcctcccaaagtgctattttaattgtgtatttattgccactctgagctatatttgaaaattccttttgtgaaaaagaatatttaaaaccagacacctccagcagtttgctgtatctctgtatgactaggttaaaatgcacaagtctgtgaaagcttcagtgacaccttcatcagtgtaaattctagagacttcacgtgccagctaaggtgaagtaagccacctacagcctctctgtcccgctcattacaaagaaaagctctggtcaggatacagaaaagcaactaccaaaggctaaaaatgagcagggatattagggactggagtcaaagtcagataaaatatagtgatgaatctctaaatgtaaaacattttatttgggaagcaagatttacagtcgaaggcatacaggcagaccaggtggtcttcagtatatcttgatgaacaaataaaaggttggcagttttaaaaagaggagaactgtttcgtgttgctctttgagaaggttcttcggcactagtgaggtttctggggagctggcaggttcccgactggtgagtgggtgaaatgagtcctcgaatcacagcaggttgtgtcggttgccattagtgaaaactggtttcaagtggcagcaggcagtttccgcggccaggctggcagagaactacattgctggaggaatgttttgtggcccgagtgctttcccccggccccttgactctgactgagttgggtatgacaagaatgacccagtttgtatgatcagctctcacagtgacaatgacagtcatgatggggatgtgttttgagggccttttcctctcctttgccgaggaactgcacagggaatgctgatggcgagacctccagggaagccacttatgtcttcaccactagagaaggggggactctgcatgttggcgagagcaggggggtgccacactccagcacatcgtgtgttcaccttctaaccgggaagctctccttgttcaggagttttcatagagcgtctgtccatggggagaggagtggctaggtggggtgggtggtggtgtcccggaaccagtcccccagggatacccagggatgactgtatatgcccggaccaagtcctgaaggtcatagcagaggccgcttctgcacagtggggtgggagagtgaaagttagactgacgcacttttgcgtgacacatgtctgtatgatttgggtttttatagtgaccgccatttgcttttattctaaaataaatcagcatgattcagtgttgtgtaaaagataaatatgaaaatgctaagctatctcaacatggtgggtttatacaaatttttcacttttttatggtaaatacatgtgggtttttttttaattaggaggaaacaaaggaattttcattctcaaaaatgaaaacagcattcaatagttatttgtatgatatttgacaaggttaccgagctgaacattaatttgttcttcattgttaaaagaaaactctaggcaaattgaatacaacagagtttaattgagcaaagaaccattcttgaatcaggcagccccagaaccagagtaggttcagagtgacaccggcactgccatgtggctggataccattcatgggcagaaacgaaagtgactccggagaatggaagagccgcagcagctggattggctaccgcagggggtctgccttgcttgagcccagttcgaacagttggctgcctgtggtagtctgagactcagctgcctgtcacaagaccaggctgtttatacatcaggttgggttacagttcaccatgtatatggaaccattaggccaaacataaaacatgtacggaggcagcctttaggcgaaacttaatttaacatcataaaaatcttgaagccacttgtttgcgtacccagcctggatccgtcacaattcttgcttcatgccacactcatcactagtccatatttggcctccttttaagcagttaattaacaggtatttttatagcataatgggtttcctcaaaccaccacccaaccaaaacccagcccttgatgatgacctgcgcccaccacgcagggcgcccttgatgcacacgcacctgccgcccccgccctgtgaccaccgccctgagtgccgggctcatcatcccttccatgccctttctacattgctactatgcatctgtgtgtattcattaagaccattacttttctttcagattttaaatttattaaaggctttagtgctgaatgtgattttgaggactcttttaaaaaaatacttttggttggaatgtggacatttcccacttagcattgtgttgctcatgttcctccatattgatgtgtgtttagctagagtacccccgtctaactctgcgaatatgccacactgtgtgcacctgctactccttaatggacacttgagctttttcagcttcttcctttatttgtttgttttgctttgctttggtgtattgtattttatttttgctattaccaacagagatactttgaacattcttttctgtgtgttcttttgaacacatgcaagaatttcttatatattgaaaagcagagttgccggatcatagtgtataggaacattcagttttaagggatcatggtaaggtgctttcccagtggttgtgccattttacactcctacagtggtgatggagacagcctatgatccacatcctttctagttcttggcattgccattcttgtacatttttgctgagtaggtttagaatgatatctcgtgtagcctggatttgcgtttctctcatatcgcatgatgttgaacatttcctcacgttcagtggccatagttatgtcctcatctttgagatgtctgttcatccatttttctattggatttttaatgctcttgtggatttatatctaggttttcaatcctggttatgatggatattgcccccacctttttgcttttcattttaggacgactacaaatgttaacaagtttgtgtgtcatcattacttcatagatccccttcagcgtctcttggagttttctcccctctaactttagcttgtcatctgaaagtgtcttcctcatgagtctttttgtgacaagtcttctgaggccatatgtgcctctgagagtatttttgtcatgctcacacatttgaatgacagtttggctggatacaaaattctaggttttagcttccttttcttcagtaaattaaaaacaccagctgggggtggtggcttacacctgtaatcccagcactttgggaggctgaggtgggtggatcacctgagttcaggagttcgagaccagcctgaccaacatggcaaaaccccacatttactaaaaatataaaattagccgggcatggtggcgggaggctgaggcaggagaatcacttgaacccaggaggcagaggttgccgtgagccaaaatcacaccactgcactccagcctgggtgacagagtgagactctgtctcaaaaataaataaaataaataaataaaaataaaaacaccacttcattgtcttcctgcatcctgtgttaatctgataaaaataaaaacaccgctccactgtcttcctgcatcctgtgttaatctggttcttgtttctttgaatgtgatctactctttgtttctggaagctttgtatgtattttcattgtctttttaatattcttgatcttcactatgatgtacctaatttatgatgttcttcctctgtatatcataagacctcacagaatgtgacgattaaaaaaatcagtataaaagacagaacaatggtcgccaaataataagcactaaataagcaacagctgtgttatattatcattatattcagctttgtgggttttttgagccatttttattacctctgcctttgcccactctttgacctttcattgctcagcaacactctgatgtaggtgaatgaaagaaatcgtataaaatgtgaaaccagttgttagcaattctggtataaagagaatttacatttttggctaaaatgaagtttgcatactatcagtgactgatatatccatgctacgcttattcatatagccatgctataataaagttgcatgatattcccattttaattttttatttaagggaacattatattttcactgaatttataatatgcttatctcccagccaataattatttttataatgtgtaagtctctgtgtactaattccaatatctggccaactatgaatctgtttttattgacttttttctcttgattttagatagtatactatctgttgtggatgaggcattgtagacattctagattctgttattttcttttgggcaattacactgatcttgtagaggcttcgttataggactaggctcttttggctttgatcttagttctaaggtgtggttcataatccctctggggtgtccatgtcctcagatgtgatcaagccctgtagtttggcaggacctgatcttctctgtcttcacagtggcaagcagatgtcaaaatctctactctgcgttttcaaccttcctgctgtcctccacggggatcctgggaatattatcctgtgtgcgtgcccttcaggagccagcctccgactcggggaaggtttacatgagggttttggctcccttcttcctagggcttttgcctgcaatatccaggcagccttgagcatggtctcaacccagtaaggctgctgcctttcagtcgcatgctaacccccacatgacttgtgagtgaggagcacccttgggaaaagccagatgaaagtgattcatgcagagttactctcattttctaagggtcacggcccttccatttcctgccttcctgcctgcatttgtttgttgttcagaattttcaaatggctttttaatattttgtccagagcttatcattattggcaaaaggatgagtctgatataagtgattctgtcattactggactctagaaatcccaatcagtaagtacattatggataaaaagacaaagtagcatggttcgcataggactcagatttgaaaatgcatttcctgtagatcatttttatccacagagaaattctggtttgcctgggaccaccgtaggagctgcatgtgtctgtgctggtgcagaggtgtctgggcatggctgaggagagcatctgcaagtgaagccagcagaggagaccactcagagtggcactgactggctcggggaagcactggggccacacggggcacttgatgccgtgggaaagggctgctctgtagcttcaggcaaacgtgggcctcacttttattttctcagctctttgaacgataaaacactgactactgcagccacaaccaagaatataacttcctctctgctggctgagccaggtatcacttcttgagagagtgagtgtggctggcagccatgcatggggtccaggatgaccagctcagcctcccctcgccctgcagggctgcaaaagtgagactgtcttcacacctctggctcgttgtcttcctggttctggatctctcagttcctctgtgtctttttctcccatttcctatcccactgctatgggtaccctcctgggtccaccatcccccatagaggagtcactgccacgtctcccccgaacgtgcctgacccttgcactgcaccctcccctgggccactgtccttctccatcactcacttccagccaacacttctgccatcactcacttccagccaacagtccgcgagtgtgttttggagatgtgcatacttgctctgcacctgccattatgtttttaaggggtgttatttgttcttaattttaaaagtaggtgaattaaacattttgcatttctcctactaaaaatactgcattgcctttttactctgctgcctcgattctgcccactgtatgccagtagcccggatgggaggagagatgctttcctacctcctgttggcgccacgttagagaaagcctgtccggctccacacgcgctcctaaggatggacctgcgtcagacatgaacccagctctgacctgtaggattttatgattatgaacatgatataattgaatttgcatttcttttgtgtgtcttgaggctactcatttattctactccagcagtctccccagctcacttccttaagaaggaaagaagtggcaggtccagtccactccagcatctcgtttggagactgagctttattaagcatctcggcgctcctctccagggaccgggcttcatgtggctgcaaacggcttctctcctttctcctgacaactcactgtggcagctctgtagtctcacgccttgacagaatggcaatgagattttctttacaaatctaaaagctgccgaattaaggaaatctgagtgtacttgttcaccgtggtagtccctgtccccacctttaactcttccctttttctgcaggcctgttgaatttcctgggtgactgttccattcatgccgttcacattcttttctttctctgcaggttttgcatgcagaaatgtgtcagtctggtgcctggcgtcacactggatttgatagaaaagtaagtaggatttttaagctcttgtggctctctggatctgatgagtttcttttcctttttgaaggctcttgcttctcagaagtactttctatcaacatggcatgttccctttcatgtggctgtgttcttttgttctctgattaaggctgtgtttgtgattgtcacactggggcttagtgcaggagataaccaaacatgggccatatgaaaagaaaaataataaaaagctgaattcctttgaacatttaaaaagtctccagactttaagccaaagcaagaacataccacttcgcatacaaatcatttctgctgccactgaaatgatagctagatcatagctagctcttaccttattttctgaaactgtccctttaatattctgtaactttccatcccctccccccctgtcgccatccagtttccattttactatctcagggcaaactgatttcagaacctgagcgatgaagtgacgggatttagtcaggcctatgaagagtcaatggcacttgcctcccataatccttccagtcccattggccaacccgtctgtccctcgcgtgatctttttggatctgaagtggtgtttcaggacccggagcgtggcctgcactgccttgttctgtttgtttgtgcaccggattcatcgtgactcatcctgagtcatccaggcagtatggaagaactttggagttattttaaaccctttggctcagaaccccatttcttctagaattaacatgcaagataattgttttctacatcttaatatacaaagttatatcttaatattagggcctgaatttactaaattaggcaggaaaagcaaccccacttccaagtttctcttgtaaaaacgtgcttgccttgtgtatcaggggaaaaatgcaagaatattatgtgtaaacgttcatgagggcacggtgagctccgtcgtggttcactcccaccgtggaaggtggctgtgtggccaacaggaaggccggggaagcgacactggtcctgatgtggagtggtctaccagatgtgctaagtgagcagtcctcagcatgggtacctaacagagctcagtgcccagaggctttccaaacagtgcaagctgtgacttagaagactgtttccaaaggctaaacagatagtggaggctctcagaagcatcacgtggaaaataactttaaaaaaaaaatgggactagatgatctgtgctcccctccccttctggttggtttggttccctgacgagactgcagttttgcgaagctgttcttgagatctgtttactggtattgctgtgcgctttctttggggcttttatttccccctctgttttctgagttttagagctctctattacctgtaacgtatatattgcccccgccacccctgcgccctccccacacacacaccggatgcgtatcccaaatctaaaaatccaaaatcaggaatgcatcaaactgtaaaaaaatttttaatgaattaaaaaaaaatagggcatcttgctgtattggccaggctggtcttgaacgcctggcctcaagcgatcctcccacctccgcttctcaaagcgccgggattacaggcgtgagtgattctggccgtgccaggccaaaatcggaaactttttgagcactgatgtgctactcagaaacaatgctctttggagcattttggacttcatgttttcggattagtgataaatccaaaaaacttaactggtaagtataatgcagatattccaaaatctgaacaaattcgaaatccgaaacgcttccggttccaagcatttcagataaagggacacttaacctgtgtatatatattatatatctaatttcttaaataaaccatatccattaatatttcagcagttatattttatccttgctgggttggcttattcaggcagctcttgggtgaaaactgtcttggtgttttctgtttgtcgtgcctccctgtggctatttccatggtttcctctggaggtgggagggccgcagtatcctttctcctccgcctggtagcaggagcccaagccttacccacgcctccatctccgtgtgggacagtgtctcgtctccatcctggatggctgctgtgtgctgtcccatcccccctggtcacctgtgtctgtggctactccggacagagccccccggtcacctgtgtctgtggctactccggacagagccctgccagcgcgtgttgagccacatgagctcagacagcgccacaagctccacatctctagagcaaaaaggtctgttaaaaatcacctagtgatgacaacaaaaatttgttttaggttattgagtcaaactaccttattttactgagagagaacctggtatttagttcacttcagctcctgggtggccttttctgcctggttcgggcagggctggcctagagctcaggtctcaggacagccccactgtcgtctgcccaacacacggaggttttcccttgaacaagattttggtgtcagaacaaccagctgcctccctgtttctttccaaaacttaaaatgtgcacagcaacatgacatcctaagcatgattcacaaaagaaaaaaaattggtaaattggacttcatccaaatgtaaaatgtttactctctgaaagacacgctgatatgaaaagacaagctatagactcggagaaaatatttgcaagtcacatatctgacaaagaacacatgtatccagaatgtataaagatatctcaaaactcaaaaataagggggaaaagaaaattagaaaatagaccaaagacatgaagagacacttcaccaaagaggatttagggatggcaaatatgcttatgaaaagatcctggaaatcattagccattaggtaatgcaaattaaaacacagtgagacagcactgtccctattagaacggatgacatttaaagactgaccaaacgcagtgttgagaactcacatcacagctgctgggaatgcagaatggtgcggccactctggaagaactgtcggtttctcataaatgtccataaacctgccaacatgtccccgcattcctactcctggatatgtaccctggaagagggaaatcttaggatcacacaaaaacctgtgcgtgaatgtttacggtagctctgttcattaccccaagccggaagcaaccaaaatgtccctcccagggcaaatgaattcagactgtggtgcatccgtatgatggaattctgctcaacaggaaaaagggacaggctttctatatacaccgccatttgggcggttcccagaagtatcacactaagtgtcagaagcccatctccaagggtggcgcatggtccgattccctttctgtgaccttctgggaaagacagaacatggggccagagaacagatcagctgttgccagggattagaggggtggagagtgtggctgtgaggggctagcgggaggggcctgggggtgatgtcttgatgctggtgtggttccacagatccacccacacgttccaatccatagcatgtgtacctgcagaagtcattttgctatttgacaactgaagtaaaagtaatacataatgtaggggaggaaaaaaacaccacgagagtgagcaggccggagagtgcagagcagatgcagcacacggctggccaccgctgcggacaacaggccatgggcctggggagcgaggggtgcagggaaacagagacctggatttgggaaaggaagtggattctacagcagcatgctctgttgtttctgggaagataccttcactcttattattaaaatgggattgagtgaggattgaaaaagagaagcaaacacccttccccatccaccgtgggatgttagtcattttcatcagacgccctttccctaaatcacgatgttagcgtttgcagccactcgtgttcttcccagaaccagtgcatcccctccctccccagcaccaaaggcccttctcagccagtgcgatcagacagctggaggttagggcagtgttctcgtctttcttccatctccccttctcctgtgccaagtgatgctatgaaggtggctaaatgctaaaggtttattttttttttttaatttaaaagagacaattaactgttaatagtaggcagttttcaaaacacaccctgattagggattcggggtacgaggaggagagtgtggtgggaagaatatggacgttggagtccgagcagctccatctggccctcctgaccccttctgagccacactcactgggcacctccttgcctctgggtctgtctctgtcctgcagaatggacaccactcggctctcatcgggcagcagcagtgccgagggcatcacacatcctgacacgaccttggctctcagcccgtgtccgcctcccgccagacacttctgccttctcagcacttcccagagctgcagcttggatggtggctgctgtcactccacattcctgtagttctgtaagcgtctcccacgcctctccatctgccatcagctgaggcacctacgactcccaggcatcgttgccctggccccaccacagttagagagagatggcaaggcgccagagaggccgtgctctcgaggcccattgctgagacaaatggcttagcaggctgttttagtccattctcacactgctgtcaagacactgcctgagactgggtgtattagggttctctagagggacagaactcataggatagctataaatataaaggggagtttattgattaatattaactcacacggtcacaagatcccacaataggtcatctgcaagctgcggagcaaggaagccagtctgactcccaaagctgaagaacttggagacactcagtattaaccatcacactgggtaatttataaataaaggaggtttaactgagtcacagttctgcatggctagggaggcctcaggaaacttacagtcatggcagaaagggaagggtaagcaaggcatgtcttacatggcaggagagcgagagcacaccagggaaggggaagtgccacacttttaagccatcggatcttgtgagaactcactatcacgagaacagccactcccataatccagtcacctcccaccaggtccccgcctcaacacatgggtattagagttcaagatgagatttgggtagagacacagagccaaaccatatcacagtcgctgtagccacctcagtctttattgagaataacttcttaaagtgtgtggatttgggtctgagtcactgttctctgaatgcagttcagcaaaagcacctgttttagtgtctttcactaagaatccacgtcagcactcacagggtgaactcccgtggtgcctccgcctcacagtgtgacagaggttaaattgcgggtggctgaattatatttacattttttatgccaggacaaattccaaactttagaattatacagcaatggagaaatccagatctttgctccaaaaggtgcccagccacagctgccattagctctatttccaagtggacgtcagtttttaacttgcatagacacagtgacttctccgcttaaaaacgctatttttatgtttttttaatttttggattttgttccccaattatgtttaaagtctcataagaaaagttttttgtttgtttggttgtgtgttttttgttgttgttgtttttccagacagggattcgctctgctgcccaggctggaatgcagtggtgccgtctcagctcactgtagcctcaacctcctgagctcaagtgatcctcccacctcagccacccaagtagctgggactgcaggtgcatgccatcatgcctggctaatttttattttgggttgtttggttttttttgtagagacagggtttctctgtgttacccaggctggtcttaaactcctgacctcagatgatctgcctgcctcggtctcccaaagtgctgggattatgggcatgagccgctgtgcccggccatgtcttttgcatattgtattatctacaaaggacatgagttactttttaaataagtgatcttgttaatcaagtgatcttcctgccttggcttcccaaagtgcttggattataggcgtgagccaccacgcccagccaaagaaaagtttttaataagtagatttgattttgcagttacaaagtgaggcagaaaattcagcacatctatgtttaatagtgtcttccatgccgctgtggtttttacagtcagaggacactcctataaaaaatacctcgttatttttatactttatcattttctgaagatttattcttgaaatatgttgatcttggttactgtgacctctgtggctcagaccctcttggccagcctttctactacctcagggcccctttttcccacgggggtcccaccaacatatgttaactcccgtaacgctagcccacgtgtcaggggagacagatccactcggaaagcagccgtgcggtacagttgagagacaaacagatcatcatcaagctctactgatgaatgcggcccctgtgttccaggcagccaagactgagttcccccttatttcccttcactgaacatgtcagccatgtttgtgatgttcttgtgtgtcccttgccctgagttgacgctgggaccagggtgcttgaggatgagctcccagcaattccaggctgtgcctgtcaccaatgtgccccgggcaagggagtcacctctctgacatggaagcccagaggttaccttctggaagcaaaccctgtaaccaacttccctccttacagggctggaagcgtagcagtgtccaccatctgtggaatgtcctctggagccgccttgcccatgccacacagaaggacaccacggttagggcacccatgcgtcacagcatgtggccagcagggccacgccacctcccagggaggcatctgacatgcacaaaaccttttgagtttttgtatgtttttttcaacactttcctaaaatgcagtgatcaaaagttagttgcctgctcctgcttgggacaccagtccctcagggggtttgggaattgttcctcccagactccggggctgacatttggagggtcaccgcctgacccctgctccagagtcagcaggatggcgctcctccaacaccactcctcccatcgcatgtgggagcaggaggggtgtggtcttggaagcgacaccctatgatgcgcattcacctgagtggccttcctggccacagggctgagccaagggggggccaaggcactgcctccctccaggcagcacgtgtgtctaaaaaatttatttataagtacccagggaatatttaaaaatatataaatttttgaatagttgagagattttaataaaaacgtttgtgcattattggcagagctgtcagtgggtgctgggtgagagccacacggttgtctgggtgacacccccgtgtccctacacaccatgactgtcctcctgtccacctgagatggaactctgggttccctgagtcacacctacattaaaacgtacacagtcatccatcacgttcacatctgtgccggcatgacctccctggggaagcgtttgcattgctgccctttttgccaagaccctcccgagcgtgatatgacctttgaacctagagccagagaacctgcttgggcgtccctgccttcgttaaatgaactgatcttggatccaggttaatggtgagataacttgtttttaattatagttttaagaccaggcagaaacaggctctcgtgcttagtctgatttcatttacgttttagcagttcattattgtaaacagaatcctaaggactgtagaccgggggcgtggaaaccccaccacaacacagcacctagaacacacgtgtgtgacatctcgagtgacgcacattcggaacagatcgtgtggatgtgcagatgtcagggagtctgcagtacctgcgcatacactagctggggctggacttgatctgcttttagcttttgccagctttttagggagtctgaagacctagtttagctgtttcattcttttgtctcaactcaccacatggaaatttcttgcccttgagaatacctctcttgccactaagtgtgaggacgacgttggttcctgggtcccacctgactagtgtgacgagtcacgtgacgcaaggagaataacgggcctgtgttctcgggctttttgtttccgtcaagcttcatgacctgcaggaagtaaaaccaggtctgcctcacgctctgcacacccctcccctccctggcggccgccctgcacaccccttccctccccagcggccgccctgcacaccccttccctccccggcgaccctcgttgggagcgtgtgaaggatggtcctgagtgcaggctgcaggtgccaggtggtgatcggcacataacgtgacagatgggcaggtgtgtttgtcacgcacagacctgcatggtaggcacctgccccatgcccatgtgtccttgcccgctgccatctgagaggatgtaccctcatcctacaacagctggcccttggtgtgccaggtctgccaggccagagctctctaggggtccgtgttgggtaagtgcacggcaggtggccccctggccgagagcctcaggaccccgctgtctggggtttgggggctgagtgtggcacagcaccactttcatgccctctggaaggcttggcttttgcgacctggcctcctcaccagctcaatggcagtttcatggcatagcgtccctgctgcccccagacggtcagaaatccaacccgagtcatatcattatcctcgtctttgtcggcactggagacgtggggaggtttcgttcctcagaactgctgcacgatatgtcttccaaaataaatgcggtttatttcaaacagcagcactcaaaatcaaggctcctcaggaaatccagtattaaccccttccgagctttcgccgtccttgtcagatgggcaaaacacgttgtttagcatctcagcacaagactggagagaagatcgggcagtttgtgcataattatttagcagtctttaaaactaggagaggaatctgttttctaattaagctgctgtgtctggaagtaaattatagtgaaccttcctcgagcgacccccccagtttctaattatctatgctaacctagcagcctgatgaataagctgttgctgctgcagtacatatttatattctgaatcctttgagagagtggcaataagatccgtgcctggaaattaagggacatttttcagccctgaaacaaagtaatgcaacacttaaacagtgctagaaatattagggttttcagaaagctccggggaacctgagagatgtgaacctgttccacgaggctgctagttagtattctgatcactggaggctcaaagcgtacccagaacttactcgtgattaacattgattgtgtacacagcatattttaaaccgctaacaatccattgtcgtgaataagtgagtctctgtgtgctgctgcttccgaggctctggtagcacggctgccccgtgtggcccagggacagcaggtgcggggctgcagccccacagccctggagcttgggtttgactctggctctgaaaccttcagcattgtgttagctgatctctggttcccatctgtgggacttccgtctcatctgagcctggggatgcagtgcagaaaatgtaaggagacctgggagctgctgcttgagagcacgtggctatccgtgcttcctggggaatgatagtgaccgtaggaagcatttactgagcccccatggtgccaggcatcgtgctgaggcctttacaaacattacctgtaagtcctccctggagcccttcaagggtgggtgctgttgttatctaccttttaaaagatggggaaactgaggcacccagcaagcacagggcctgccaagcaccacaccattaggacaagctgggacagggatttgctggcagcctccctggagcctgcatctccttcccctcggcatgggctgtgtgaacagagcacgggctcctcaacaggagcccagacctctagaaggtctgcacagggtttgggggggcagcactcgtgtcagaggcacagcggctgtgattagaattcacttcatcgagggaagtcatacacatggattatgtttgaaaggaaaactatcaaaagatcccagtcttgattcaaaaaatacctttctttccaacataaatatacaatattggctggtaaaggtgaaaatcagtaattcattaacgtctgccagtcactgctgagatgagtaacgaggcactagacgctgatttagaaatgaagaggtggaagcaaaacccgagagatcgccgagcgagggggaggtgagtgattggcggaaacgggggaccgccgccacctagcagatcacccctgcctgcccgagcacagccacctcagcgttcccgtgcgcgccacgccagggcgcacggtgctgcacgggggtccttatgcccgggcgcctctcattaaggtccccccacgggcagagggaagacgggcaccgggtccccttcgtgttcgatgtgcaccccagcaaggcctccttagctcatccggattggtaggggtggaggaggcttggttctgagatgaaattgcagacgtgcagccaagggggaatgtgagaggttcagaggccaccccagggaacctgcacacagcacggagatcttccgtttccttcacagtggtacccaaaccctggtatttgtcatcaaaacaaaggcctgcgccacagagcacggagctgtaacatctgtggcattcgctccacctcctcacggctctgcacctcccagcatcctaaagaaaacgtgggctgggcgcagtggctcacacctgtaatcccaacactttgggagtctgaggcaggcggatcatgaggtcaagagatcgagactatcctggccaacatggtgaaaccgtctctactaaaaatacaaaaattagctgggcatggtggcgtgtacctgtagtcccagctacttgggaggctgaggcagaagaatcgcttgaacccaggaagcggaggttgcagtgagtgagctgaggtcatgctactgcactccagcctggcgacagagtgagactccatctcaaaaaaaaaaaaagaaaaggaaaagaaaatgcatgtgtctggatatctctaaaggaagccctcgctctgcggagatgcaggagcacagcttgattggagggcagcttccgttccttgaaggcaggctcccaggtgcagagcgaggaagaggccgcagtgaggctgagcgtgtgcctggtcagtgccccttggccgtcctttctgatgttggcctttgctcttgtgtaggagtcatctcagacggctcagtacctatggaggcacacgtcactgcggtcgcataaccgggatgaggctcagcccccattgatgcctcttctctagacgcatcgtagttcagcaggtgcacctccctccgtccagtctgccatttctccttaaccttccctgagagtctgttgctccagctccattgcccgcacggcccttcggttcctcacaacccctggttctggtggggtgcctggagtgcctcctctggcaggggtgcctccttggatctgtttatcctgcaggattcagtgccctgccgttgttcctatgtgcgtggctgcagacttgcaatcggtgataaagcagtgtggcgtgaggcgccagcataaccggggaccccgggtgtgtggtggcttttccggtgctcatcacagccacccggcgagcagcctctgaggccatctccatttaaacttctggaaaccgaggcaagggaggtggagagacttgctcagggtcacagagagtcacacgagggtcccctgtcggtggcggagcctgtgtccgcccccacccgtcctgctgtgtctgcccccagccgccgctgctggcttctcagtttgctgctccgtgctgcacagtcccctctgtcagagcctggtcgctgtgccctgtggcccttcagagaaaggcctccccgttctgatgtgcgtgtgttgtcttctgacctcgatgccagtatgttttgcgtgagtggccagctcgtcagcggggcctcgggttccaggctcgagcgcacttttcagaccccgcgtgtgtttctcagcacgtttgttcattcaccgttcattcagcagacatctgctgcggactggctgtgtgctagggcctgtccgaggctctggagccaagtccttgctcgttaacttacatcctgatcaggggaagaaacgcacataagaggagtgtgaatgtaccaggagagccatgtgatcgcacacaagagtgcctggatgcttctttgattgggcagcctgatgaggcccatgaagaggcaacactggaactgagaccacctggccagacgggagcagccatgccgggaccaggggcagcgttccagacggggagccccacagcctctgagccaggcacgagcttgggctgtgtggcaagggccttctttgaaagaggcatatgtagcttcagtatttataattaacaccgctaacctggcagcacttaatgggtctacaggggcctgtgtgagtctgactcagaccactgcatcagatggggaaactgaggcacttaggagcttgatggctacctacagaggacattttgctccatgaatcagtggcgtgacccgcagtggccgcagaaggggcagtggcacaagcctgactagtggctccgtttgcagagggggtgggggcgactgacggccagcaggagggccgtggtgttctcacctgagaaggcgggcgagcactccttttgctagaagaggctaagagatctctacgattatttccatggatgatgacccaaacagatttagtgtggctgcgtgtgtagctgctgtgtcttctagctgtttctggagaccagaatgtgcctccccgaaatatgaagaattgttgggctgaagacaattaagaagcaagtgcaagagagctcctttcctgccttctgtttccctaaagcaaaacatagatctacagagacaaaggcatcctgtcccgccccgtcccagggaggacagcagcaagccccgaagacagctccaggcccacgcgaaggtgtttccttcattttctagatgaagtgactgagtctcagagaggttaactcacctgcccaaagtcgcacagctaggagtggccgagcctggaggacagagccgggtctgtgtgatgccacccccaactctgcatcggctggcgtgtggaaggacgtccatcccttcacgtccctctgcgtgtttgtgagtgcgattctgaggaaagtggcatgagttttctgcatcaagatgcctggtctcaaagggcgggttccatgtggacctgacaaaatgaggggatgtgtacagcatgggaggagagaccggttattttgacccaagccccgggtgcccagtggtaggaggagtgctgaccttctgtgtgatgcatgcccaccaggaaaacctcagaggattatcccagaaatcaggcataaccacacaaggctgcctgtatttggaaactgtctttcctagggtgttttaacaaattcacaggaagacacaatttacaaccaggctaggaagtgactctgggatttcagcatcttttcagagacagaaagatccagatgagctcaggacagtcgggggaaggtggtggcaatctctgtcagaaccgtggagtgttcgttgaagatacttccacagcaggagagctccacgccccatcctggaagctcaccctcctcccctcccaccctctttaggccagatttttgcagagaagctccctgatgagatgcagcgtgcaggtgagagtggcgtctggagacagcctggaggcggccagtgcctccggagggaagtgctccccaaccccggctctgctggagcccgtcctgcttccccttattttaggagctgcttttctcgatgtggcaggcctttcagcagcttctcaggagactctgcttggaggtggcttctcccatgtgactcctgcagctgcctctcaggaaaggtctgtctgaaggtcggccctgacaccgggaagcccacagaaaatctgttttgcagaagtgcttcaaaaataaacatgggctcagatgtctttctgatgggctttggaatctgcctgtttaataaaaaagaatctgcttttcattatgtcatcaacatgttgaataagaaaatggggaattacccctcgcctcgctgtggccccatctctccctgtggtttttgtttgcagcctccagagtggccattcctgtccattgttgttgttgactgactccaggaaggggcaataatttgtcgttctatagtaagtcaggtaaaaggtgaattatctcctgtaatattaactctgcttactgttaagtcagggaaacttcctcccgagttcaaccctacatttacttcacaagtaaagatgagcagaagtctgtactaggggaaccattaaatacggaaggacaggatccaaagagatggcagcactgtgcatatgaaccatgtgatttagaaaccgagcagagatttttaaaaatcattaaaaaacaagccgcctctggtggtttttaaaaagccagtcagcttatgcaggggtggaattatggaactttctagtttctattgtctctcgggtgccatgttcactccaaaccatttcggtaaccctgagccagtatatcctcctggagaaattaacaactgcttcctttaagtcaatgtttttcaaagttcaagtcatggttgattagtggctatgaaaccagttaggtgggtcacagccagcattttaaaaaagaagaaaatgtcattgttttcatagtaagataagtgttccgtggtcctgttgcttgaacatgtatctcttttttggtttgcttttttgtttctgttgtttggaggcatggacagggtacgaacctgtgaatatgtatctttatatgtggttgtgtatgtgtgtttgtctggtcaccaaaaatattcctagggctcatgatcaaacaagttggaaagcttcttatttaaatgatctctactcttatgttaattggggacctagacacactgaccaccttaattgcctatactttagttaccatcagtgttgtgaatacttagtcgttttccaagaacaaccttgccccaaatccctgctctaccatcatcagccttgtgccatattatggtttcctataatctgtcccatttttaattaggaatattgcttatacgtatatcttttttctttgattttttcttttttttaaattctcttttgcttatacatatatcttaacagcctcttcttttcttgttgaagaaataattttgacaagtttttacattttactttaaattaaaaactcatttcccttttgaccacatgcattaaccctcagaactgaagaaggccagattaaccgtaccaactcacccttcttgggagaatgaagcaaaccttttatcatcaagatatgtcaccctttatctctggtaatgccttttgccttagagtccacatttttaaagtatcgtagctgaacaactgtctcttggttagtgtttgcagaatgcatcttttttatccatatgtatataaggtagatctctttttggcaatatagttagcttttatttagttttgttttaaaatagagacagaacatttttggttttaattaaagtatttagtttgtttacatttagtgtagtaattgatatatttgggtttaagtctgcctcctacttgcttcatcctttttttttcctgttgctttttattctagccaccccaccacccttttttttggagcggggggaacggagtctcactcttgtggcctaggctggagtgcaatagcacgatctcaagctcactgcaacctccacctcccaggttcaagtgattctcctgcgtcagacttccaagtagctgggattacaggcacacaccaccacacctggctaattttttgtatttttagtacagacagggtttcaccatgttggccaggctggtcttgaactcctgacctcaggtgatccgcccaccttggcttcccaaagggctggggttacaggcatgagccactgtgcccggccaagccccttttttttttaacttttcttttttctcctcccttaccatcttttgagttgatttagcaattttattacacctttcttctcttctgttggcttgttaattttatattctttactatactttgagcatcctgttttttccattaactgccagatagtatatgccttagactttgcaggccatgtaaggtctctgtctcatagtcttcccattgttacaactctttaaaaatgtaaaaaccattcttagcctgggggccttaagaaaacatgctcctggctggatgtggtccttgggccatagttttggtgacctgctttagaaactataacgtgcatcctgctaaaaactaatctaagcctggcacagtggctcatgcctgtaatcttaatgctttggaaagctgaggcaggaggatcacttgaggccaggagttcaagaccagcctgggcaacatgataagaccctatctctaccaaaaaaaaaaagttaggcatgatggtgtgcacctgtaatctcaacactttgggaggctgaggcatgagaattgcttgagaccaagagttcaagaccagcctgagcaacatagcaagaccccagctctacagaaaaaattaaaatcagctgggcctggtgacatgcccctgtagtcccagctgcttgggaggctgaggtgggaggatcacttgagtcccagtggttgtggctgcagtggctcgtgatgcaccactgcactccagcttgggtgacagagcaagaccccatctgctaaaagaaacaaaaacagagtaccctttagtacagatctgctgggaaaaagttctcatttttatttgtttgaaaatgccatcatttctcctttgttttcacgttttcaaatcagcgttcttgaggtgcattcaataaaatatacccacttgagctgtacaactgatgagtttgacagaccactgtgcccgtggagccacaccacagtcagcgtatatcccgtgtgtccccttgtacctgtcccagttaatccctctccttatccctcaagcccaggcaaccattgatctgggttttctcactatacattcgatttgatgtttccagaactttctgtaaacagaatgataaagtatgtgctcttttctgtctcttccttggctcagaatcatgcctttgagatgtctccttgttgggagtatcagtagtgtgttcctgttcattataagtaacagcccgtcaccctgtgtgtcacagtttgtttcacctgttgatgcgcgtttgaattgttcctgtcctgactgttatgaacaaagctgctgtaaacattcatgtgcaagtctttgtgtgggcatatatattcatttctcctggataaataccggagagtgaattgcttggtcatatggtaggtgtgtgtttaactttataagaaattgtccaactgttttccaaagtggtttgctgacctgagttcctgccagtaacaacagcgtgccagttgtggcgcatccatgtcgacacttggcattctgccttttcggggttttttttattttattttttgagatggcgtctcactttcttgtccaggctgcagtgcagtggcacagtctcagctcactgcaacctccgcctcccgggttcctgcaattctcgtgccttagcctgttgagtaagtgggattacaggcgggcgccaccacgcccagctgattttttgtatttttagtagagatggggtttcaccatgttgcccaggctgatctcgaactcctgacttaagtgatccacccacctcggccacccaagtgccgggattacaggcgtgagctaccgcgtccggccatcttaccgaagtataacacaatatcattattattttaatttacatttgcctaatgatgacagagcagcttttcctatgctgctattggccattaatttatattctttaataaaatggatgttcaagtctcttgccaattttcaaattgtggtgtttgtcttcaagagcccttcatgtgttttggacacaagtctttgtcctatctatacattgtgaacatttttgctaagtctgtggcttgtgtttttatttctaaaacagtctaggccaggtgtggtggctcacgtctgtaatcccaacactttgggaggtcgaggtgggcagatcacaaggtcaggagatcgagaccatcctagctaacacggtgaaagcccgtctctaataaaaatacaaaaattagctgggtgtggtgtcacacacctgtactcccagctactcgggaggctgaggcaggagaatcgcttgaacccgggaggcggacgttgagtccgtccagcagtgagctgagatcgtgacactgcacttcaacctagacaacagagcgagactccatctcaaaataaataaataaataaataaataaataaataaataaataaataaaacagtcttttgaagaacagaagtttttcattttgatgaagtccgatttcatcatttatttattttatgatttgtactttctgtgtcctacctaagaaatctttgccaaccctcgggttgtgaagattttctatttttttctaaaacttttagttttaactttcatgtttatgatgaacttagtgaactatgattaacttttaagtctgcgatccgtttcaagttgttttttaatatagtcaagagtcaaggatcattattttccatatagataccaaattgttccagcactgtttgtggaagaggctatctttttgtcattgaatttccttggtgcctttgacaaaaatcatttgactataactgtatagttctattctattctcttgatctgtgtgtctatctttattggcataaagataggaataccacattaccttgatcacggtagctttattgtaagtctctgtttttgttttgttttgttttgttttgttttgtcaaaatggttttggctactctagatccttgcatttcatatgaatttaaaaatcagtttatcagttctaacgagaagcctgctgagattttgactggaattacattaaatctagatgaatttgaggagaattaccatcctagtaatatggagtcttctgacccatgcacatagtggcttcatcttccataatcatcacatactgatttagttgtcttggtgccttggagctttatctgtacatatcttgcaaatattttgttaaattaatgtcagtttaaaaattatttaagacagcatatagaaatgtaattgatttttgcatagtgacctcatttcctctaactttgctacattcacttattggctctgggagctgtttgaaaggtttcttaagatcctctatgtgtgtaattatgtcatctgaaaatacatacagtttgacttctttatttccgatgtttatgtctttaatttctttttcttgctttgttgcactgcgtaatgtctccagtataatgttaaatggacgcaatacagctgggtgttgaagccctgatctgagtcaaggatcaatgacagggaacattttatctaaatctactaagtataatatgtgctgtgaatttttcatagatacccattatcaggttgaggaagtgcgcttctagacctagttttctgagagtttttctcgtgagttcttgttggaattcgtcagcggcttcctctgtgtctgtggaggggatcgtacagctgttcaccctgttcagatggtgcatcacatgaatgatgttcagatgttaaacagtcttgcatccctgtggtaaaccccagctggtcatggtatattacccttggatagattgcgggattttacttgcatttcattgaagatcatctcacatgtgttcttctctacctgtgggagacagccacgccctctccaacaaggcctaaacctcactctatccacagaacatagccacgccctctccaacaaggcctaaacctcactgtacccacgggacacagccacgccctctccaacaaggcctcaacctcactgtacccacgggacacagccacgccctctccaacaaggcctaaacctcactctacccaagggacaccgcctctctccaacaaggcctcaacctcactctacccaagggacacaaccacaccctctctaacaaggcctaaacctcactccaccggtgggacacagccacagcctctccaacaaggcctcaacctcactgtacccacgggacacagccacgccctctccaacaaggcctcaacctcactgtacccacaggacacagccacgccctctccaacaaggcttaaacctcactccacccgtgggacacagccacagcctctttaacaaggcctcgacctcactgtacccacgggacacagccacaccctctcgaacaaggcctcaacctcagccctacctggggcctcctccaggtgctgggattacaggcatgagccactgtgcccagcccttgatttcttaatatactaaatttttaatttccagggtttaaaaagaatagcttctagttttcttccaaaattgttcactttgtcctttaattccttatacatattaagtaagatgattgtcaagtctgtgcctggcggctccattatccaaatcctctatctctgtcttgtcagctgcttttcttggtttcaaacatatatacagttttccagtaattacctgtttttttttttaattgaatgctacaaattgaaaacggaaattgtacaggtatttggggtgatttgaggctgtgaagtctgaattgttttgagtttctttttcctcctacgcgccttttagagtctcagctcaacaactgaggagtttccccagatctgcttctccttggcagtgcatcacctcctgctgttgttccccagccccatgagcctgccgtgatctactcagcgtccctgctgctgggtcccttttttggagttgccagatgcttccaagagaggtggccccaaacgaaagctcaacccctggcttcccctcctcgagtcttggccccataatttctcatagcctggctgcctttccttgcttctaaaatattcccgaacatacacacagcctttctagctgttctccaggtgagaatggtctgaatcacctcatctgccgttacccgcaagggagcccgtgctgttctcaaaaccctaaacctgtgggaaccacacgcccccagatttgtgcacgtgatttggaatctggtgggctcagctttttagataatgcccagtggctgcacgtgagggtccgcaggcacagagttggacccacgtccccagccttccatgtccagctgggactctatgtggctctcttgttcccgttcctgtccctctgccctccagactatagcactgcagcccagctgacagagaggccgctcctctacctttaagttgcaaactattcagaccaatatcgtgtattataatttgtaaaccatgggttttatgcacgctaaaatggactttaattatgatcactcaaagtctgtaaatggctataatattgggcactgtgtagtgagaacatcaggtaatgttacagagcgctgaattgtacatcattttaaataaagagaggctggacgagaatatcacaggaatgcacgtttccttggttcagagcaatattagcttaagaaaaagtattttcactggtttcacgaaaagttatcacctggtgcattatttcctgatcttcacttcgaattgttttctttccccaaagagttgtatttttacaatgaccgacatgtgtgtgtgctttatgtgtaaggtttcaatgcagcgttcattgagaagctggatgaactcatcacgcttttgcacctgctcagattgctttcagtaactctcctgttactccagcccccactgtggagaaccactggtctgagatagacatatatagcttccctcttactagcaacctagccattatgcactgacctggattttcaaaagaattatttcaaaaaagaaattgctcagttcacctcccctgaccttggcatggaacctttgtaagtaattaattatttgcagtaagtaagtgaaccagcccaagcttctctacaccgtcattttcatagtagtcatttaaatttaagtgcgtgtccttctttaactgaatttaatctgagatgatataaatttttaaaatcatacagttttgactcggtacggtggcttatgcctgtaatcccagcagtttgggaggccgaggcaggtggatcacccgagctcaggagtgtgagaccagcctgggcaacatggtaaaaccccatctctaccaaaaatacaaaaaattagctacgtgtggtggcatgtgcctgtggtcccagctacttgggaggctgaggctgaggtgggaggatcgcttgaggctgggaggtggaagttgcagtgagctgagatcaagcctgtgcacttcaacctgtgtgacagggagacctcatctcaaaaaaatttttttttcataagacagttttgaaatatcttcccttttcaggaaacttgctgtagcctccttcttatttaaaaaaaggggggaaaagttttgttttcctttaatacgtaaattgtatgttttccgtgtagattattaagcacataagcaaaaagaattaaaatcatccattttctccagcatgccgggataaccattattaacactttgtgtatacccttccagacttttgtctaagtgtattcttgggtatttttttgattttgtgcccaaagagataatctaggggaatggccaccagagcgtttcacgagcttcttagatgatggaatttgggatgatttgtattatcttgttttcttttttatcatcatttgagtacttttagtgagtttgtcctatttcttggaaaccgtagtttttcatttaacattttgtttacatacagtttgacaatcattcagtggggattcacccattggctcatcgtatgtatgcggcacctgttctgtattcaacgtttcatgccatcaaatatgtacacggcatctgttctgtattcgactttcacgctaagcatcgtaacagcaagatgaagaaagaatgtagtcctcactttcagagcgctccaagcctcagcttagacacagcctaggcaacagtgtctcagagacattcacagctctctgggcaggcatcaaaggagcagccccaagcagggaacccctgggttggtgtgggagagaccccaggggagtgtcctgagaggaggccggacttgagccaaatgataaaggatccataggtgtcccctaagccaagaagacaggagggtggtctgagcagagcacacaggatgtttgagaatgacaagtctgacatggctggaaagcgatgtatttggtgaaatagaaagatggggaggaacagaaaatagcaccaggaaggtaaacatgcttgagttactcagcctccaccatggcagccgcgtgactgtgctggggagcagacactaggcagttaggggtgcacaaggtttgttggatgtaacacctggcagaggccaggacagaagctggacctgatgtacacctggcccaggctctgctggccccatagagagagagctgtcgctccaactcagaggtggcccagcctctgcaggccccgtggagagagagctgccactccaactcggaggtggccagactctgtagctcagctgtgctacagggccacccagaacagagaaaggcctcatctgaacactggcccagtccctgtgcgtaccagctgggactgtccctgtaccgcgctttttcctgccaagggcccagccccgtgtccacaggcagcagacagccatcggcatcagtgggagcagctgttttttaagtggggaagtgacatggcccaggcctgtggactgtggagatcacaccatgtgcttaacgagctgccgggagctgtgagattgatttatgtcaaggaaaacaagtcattatccatgggaatttatctagctacacagaaaattaacagtggaacaatggcgggtaataaaagaaaaagaaagtaagggattcgttgagcaccaaagaaatttagaggaagatctcagctgtcatcctgtgctggacagtccgtcacgtgcagagcatcctcccgactggcgaggtggcttccacgtgccccgtcaatcagggctggacagtccgtcacgtgcagagcatcctcccgactggcgaggtggcttccacgtgccccgtcaatcagggctggacagtccatcacgtgcagagcatcctcccgactggcgaggtggcttccacggagcgattctcgagacccgaggggcgtggacacagcttctacgcaggcagtcggagagccactgggctcttggccctcactcctccagccagaggagttttgctttcctttgtcctgcataagattttgtttgagtagctaaaaagtaatggaaaaccaccacaatgatcagtggagaaccttgtatgtttgggggcccagctgtgtgttaagagccatcagcctgtgtagcgtgagccagggcagaagggcctggcccgagaatgctgtctggacgcctggcaggcctggctgcagggtgccgcagaggaggtgggaagaggcatctttgggaggcctggctggccccagtgcaggaccagagagcagctgagggcctggggcctccggggtttcgagcctcagtgaaacgcgaatccacagggactcttggagtggggaccagcagtggagaagatggaggcattgcacttgattttacacacgttccgcttgagctgtgatgccaggcaagccgagggtgaagggaagcgccttgtcgtgagacctggaaggagcagggctgccgctggagcagatcctggggtgtgaaaagagctggcgacgcagtgctcccagaggtcactaagggaggagccgggtgccaggggagagacagtcaggatttgcagattcagcaaatgaagaaaggcaaggctggccagccactggagtgagggggcttgggaggaggtggcttggaagggcggtgaggacagaaaccagctttcgcatggcaggtaagaggagcctacgggggccaaggagagcttagctagtgccagcttcagggccacatgggttttccccagggtagacaggcataaggccccagcggccactgcatgttgagccccagcagccagtggtctccccggcccatccctggtcctcccattcctgcgaggcggctgcggggtctgggtctggtttctgccacttgtctctagtggaagacacaccctcatagagcctcagtttctccatctgaaaagcaagtgaacataagacctgcctggcgtgggcattgggaaggaagtcttggtggacttggcaggtgggtgacttgggggcctgggtccaccgagccgcacagcgggaggcacggcatgagtgcccagctggcagcggtggtggaggtagtgtaaatgttcatgctgaagaaaatccaagcctctgagaggctgggcagctagtccacagtcacagagccagtctctggccaaattcaagcccccgtctgtctggctcccaagtttaggcctggaagtgaaggaaaaggaaggctgggggttctgcaggggagacatcctgatgacctcacagccccttgtccttgtcctctgcatggatggggccagggacggcagtgaggcggccaccccatggggaggagatcatgtgttgcgtctcctgagtgcagacggagctgaaggcgcccccgagaatccaggtgagagcaggaacctggagagactgggaggcaagcacctgccacgtgggcacctgtgagtgaaccggggagggacagggccccaaggagtgggtggcacctcatgctggaagtggggagcaggcagagtgatggggcaaatgacagggagccgggcaggtccgggagaaggggtgggggagggagcacccttgggagagtgactgtgatgggctgtgatccctcaggcatctggtggagaatcaaaggcgagggctggagacacagcagctcttgttgagtgacaagttcccagcagagggtggtggtggggacagccaggggtgtcagggaagaagaaggggccttaggggaagggcacctgcttggcatttcggagctggcctggcactctacagtggttgcacaaatggggtgtggatgctgaagttctgccagagtctagcagggccggggtcatcatgatgacctggatgttgcagtaaggaagataaatcctggcaagaaaccgcatgccacaggtgagcccggaagtgtgggggaaggtggagataaaccctcctgccaatggcagtgaaggagagtttgaggaggcgcgggccctgttggggggccaccccggcatctgccacatctgttgttggagtgtcatctgttttattttagtcgccattttgcatcagggtcagctgtgttgactcagcagagaaacaggtaccacgagtcatccagccatagcacggctgggaccagcgcttgagttttcttgtctcccaattcaggagtcttttcctgaactgtagctttttacagttttcacatagaagtccttgattaacactctgaatttaaattttaaaagagccaccttgatcattaaccctttgagggttcagagaaacttctagaatgaaacatggtctgacatggacaacatacaccaataggcttcttctgtggtcccctcgtgatctcagtggcctcccgagttgggcaagactcagcattggttaggatcaggtacagaaaggaaatcagaaacaaatcgtttctgcaaggatttaattttatgtgacgtgaaaagtgagggatgctggactcggttccaccttgtcacccccagtaggaccaggcctgctggatcaagaagcctcatcagcttttgctcactggatggttggttcatcgacttgaatgatttctgggtctgtctgaagtcggctgggcagatgactctgtctggtttcacgatgagcttagggaagagaccagtgggattttcaggaccatgttgggagagtctagctttgcatttatttactggtgatcatcacaagataccaatttgtaaaaacacaactaagtacacactggtcctatctggcctccgtttatcttgatggcttggccatccagtgacagtgctggggtgtgggacctcgtgggaagctctttgctgctcagaatgcagctttctgttaaccagtggtcacagactcgggaacagcaggggctctatgagcttcagtcgattcaggatacgtgggctcacgttagggatgtgtttagtcctggtttgcaaacagcctgcgggcaaatggtctgtctgtgcttgtgatggtccctgcacttcttccggaatgcagccctggcccccgccagctgctcgagctgtgctgcacccctaggctccctccccagcatcaccagggccaaggatgaggagatgcaggagccagggttttggcagttccctgttactcaggtgggcacactcattgcagtaaatgttgatgtataaagacaaggaagggtatccccatgatcgcattttgaggtttttcctccaattgtttctccttgcacatgtttgatgtaatcgtgactatagagtatttgtcttgcttctttacttaatgttataaagcattgtcccatattattgaaatattcagaacagtttaactgcttgtagctgctgcgtcgtggttgttgcgtggtttgtttaatcatttccctctcattggtttcggagcgaattttgggctttctgcaatggcagatgacacagcaccacacaccctacatcccatttccccatcttgcttccggtttaggtatggttggttcctggaagttgatgtactgagctatgtagatttttccgacttttacatgtggtaaagaaggtagtgccagcgcacgctcgtacaggatagaagtgtttttgtttagggcagggacagacacatccagctgccttagaatgggggctctgcacaccagaaagaccagctgtgtaacgtagagtgtggactttgagtgatgcagtatcagtcactcaatcggtcttgtctgtgtgactctgaatacacagactccgggcacttcccaggctggcagtgctccaggcacgttgttacagtcgtgctgggagggtaacatgtctgaaccccatggagcgaggacctgagctctgcagttggtgttgggccccaccctgccctgggcgcctctcttcctgaggcttggggacggtcctctgccctcatagtttgactaactccagatatgttgagagaggagagaacccgtgacaggatgctgaagatcagcaactcccgtgtcctccttccttgcacagtcgggccacttatgtgtttactgatcctaggccacagagcttcggcgtgtggtctgggcgctgtctgtcctctgcatggctttggtaaggagggcaggcagcgctcggtgacagtcctgcagcttgaaagaggcggtgtttttgcggaacagttattgacgatcttgtcagtcatttcattaaaacggttttcagcatatgtgtttctcatctgcaggtgtgggacccaagacacaagtgtgttggggctccatgtccaccccacgatgccccccgtgccccttctccgtgctgtttcctagggctgtgtcccgggcagccacccctgttcgcgctggcgcttgagggctgagatgagcaacctggtaaaatgagttcctggattgtttgcttgcatttcataaggaaatgtcttctctttgggaggtgtgccccaccctcacattcctccgtggggccaagctctgtcgtaggttgttagagggtgggcacctttgcttttcctcactcccctgctcggaggtcggagggcaggcagcctggccattcctcctgcgcacagtggacatgcttgttctgaagcgagagcagactggggagaaggaggaggggctgagacgagtctctgctgtccttgtgccgtgtgttcgcctccaggcctgggtttcttttaaatggtgggaatccttcatgatgcctgccctccaccacccacacagctaatgaaaggggcttctccgtcatccccgtcctggccagcagcctgactagaaaaccctgatgttgggtaaactggtctccactgtggaggtcgaaatttttcttgaatttggaaatctttgtttgagacttccggcattgtttgagcagcagtgctgctttagaatattatactaacttctcaatttctcctttttcttgccctatcactgaacctattttgaggaaataagacgttattttctgttcgtaaaggaaagaaagagcatgtgttgaagaattacattaagaagcttgcttaggctgggcatgatggctcatgcctgtaatcccaacactttgggagggtgaggcgggaggatcccttgagcctaggagttcaagagcggcctgggcaacacagtgggactccactacaacagtttaagaaaagaagttcactgaacttagctaccctgtgttactgatgcatagcctctttgaatattattctgatgaagacggtgccatcagatggttcctgcagtgggaattgctgatcagctaaatctttttgacagcgggatcatgcttatggctctgaacacgtggcatttggttttccattccgagttacttcacttagaataatggcctccagctccatccaagttgctgcaaaagtcatggttctgtcctcacggctgaggagtggtccttggtgctgcctgccccatgcgaaatggcagcagcctcatccccccgcccactctctgtcgtatttgtctctgcgtcatctgccgtcacttgccacctctaatgtgtgcttgttcatttgcctgttacctgtccttccccctagacccttaggacagggcctgggcgcgcgctggcaatccccacatccctgtcgcaggtatcagctgcgtgttgaatacacgggagcaaagtagaccttgcgggcgagactcctcccagcatggacggtgtacttccacagcgttcggtggctgaggtataaccctgcagagcatgatgtggactgctttcagcacgtgccacagactgcccttggggtccagtcatcggtccatgggaaccatgtgtgtgaccagctgggcttggtctgtaagtctggggacaccagaggaagaagctgttttggagatgtgcgggaaggaggaaagctgcagatggaggttgagctctgagctgtgagctcatggagagtttgattctccctgccgtgcgccaagcttctgctcagagccttcctccctcgctcagagcctttcgccgcccgcgcccttttttcttgcaacctctcttccattccctgctctcagagctgtggcatcactcatgagaacgccccttgttttctaggatccctggccgcctgaacgacaggaggacgcccctgggtgaactgaactggatcttcacagccatcacagacaccatcgcgtggaacgtgctcccccggggtgaggcgcgggccgggccttggggagggaggctatggccttgagtgcgcggggagccgactctcggacatgagaggagtcagataggatccgtgagtgcctccctagtgaggaagacagtgggaggggctgaaaagtagaaggcgaccacctaaggaggtgtctgcgagggggtgagttactgcacgccaggttctcagaacggtggtgtggagagactgcgtgtcagcgctggccctgaccggtgcacagcccttactgcgcaccggcggcttatcttcagagtcgtcggcattattcacactggctggaaaccagaattgctgttgtaagacttgtttgtattttttattgattggttgatttggggtgtttgttcacatgtacgtatatgtgcactgtgtgtgtacatgtgtacatgtgtatgcatacacgtgtgtatatgcatatttgtgtgtgtgtatttgtgtatgtgtacacctgtatgtgtgtgcgtgtatttgtgtatgcgtgcccatgtgtaatgtatctgtataggtacacacctgtgcacacacatgtatgtatgcatgtgtgcatgtgtgtacatttgtgcacgtgtgtgtatgtttaagtgtgtgtacgtgtgtgtttaagcgtgtgtgtgtgttgctgatgggagatatgcatattagtcccaactttagtaatttttgatagaagtgaatttgtgtatttggctttaaatgctagacacaagtcactgtagactcctttttatcttttatctgccctcagatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggtgagtgtttcaggatcctccaggtgccgtgctcccccgccctccgtggcactgtgatgtcatggaattgcacggagctgggcagggaggccccacacctaacttggggaccccgtgtagcattaacaagtgaagctaaatgcagggctcccagagatctccacacagaggagtgggggtctccttcagagggcagaagccttggagggccttttaggactgcacgggagcagcggccggctgaagcctcacagctctgcaactcgggagggtagcactttgcaagagagtttctaaccttttagaaaccagtagtgagaaaataacttgctgacttgaatttatgaagcacatgcaagatcgctctggagaattaaactgttgggctcatgatcaattagtttttatgcttatttctcacacacacacacacacacacacacacacacacacacaacgctcataagtgtaatcctttatgactattgattatagttctctcccattgctgagttgctactatttatacaactcctattagtagtaacagtgacaataatgtgatttgtttttagtctagacattatatttgaagacgtttggtttctttctgttctgtggctgtcctaacaagcaggtttgggcaaattctaaaatggtattaaaacaaaggaaaaatatttctgttcatcaatgggagaaaccctaacaacacaaatatttttaaaagagcgattaacgtatgcctagccgcagaagccatcatgtggcgtattttcatggccaggtttattttagctagtgttttgtgttttctttttaaacgtgtacaggaccactttccctcaaccctggaaacccagagaagcaagaaggaatctaaactcactacccatcacccactccagaaaagttagaaataatctaatttttaatgtttataataaatatttatatgcgatagatcaaaatacattatacccagcatagcacttggactttaaacagcaaaagttaaagcatgcatgatctgtatccttcttaagactctgtaagataaaatagagaaccctgataaggagaaaaggaaattgaagtaaaccatttaaataatgtgtaaataaaaccaccgcacatttatttttcacgaatccatgaataacagagctgtaaaagagacaggtgtttgaaaagcctttgcaatacttagaataaatatttaaaatgaacattttttaaaaataaatacttagagcatttttgaaagagtatattctcaaaatggccttattcctttaagaaaagtaaggccttaaatcctgtctctatttcctctaagacaggttattgtaatacatttattttaaaagaggaaggaaaaagaaaaaaaaagctgaaggggtcagtgccacatcagatcctggatcaaaaactagttcagcactgggagccggttgagcactcggagcggggtgggcagggcctccagacttgcaggttcccttaccaggaatcagtccatggaaacctttttccttctagcgtatgttttctccagatgtaaaagcacctcctatctgatgtgctcagctgcgcagagttaaagacagtgacatcacattggagtccgtggtcaaagaccagagccagagcacagagaggagccaggagggatgagcaggcgaggacaggtgcagggaggggcatgtggcaaggccggcgtggggcagccacatcccacctctccatctagaggccgcgtggcgaggccagcgtggggcagccacatcccacctctccatctagaggccgcgtggcgaggccagtatggggcagccacatcccacctctccatctagaggccacgtggcgaggtcagcgtggggcagccacatcccacctctctctctagaggccacgtggcgaggccagtatggggcagccacatcccacctctccatctagaggccgcgtggcgaggccagcgtggggcagccacatcccacctctccatctagaggccgcgtggcgaggccagcgtggggcagccacatcccacctctccctccagaggccgcgtggcgagttcggcacagggcagccacatcccacctctccatctagaggccgcgtggcgaggttggcacagggcagccacatcccacatctctgtctagagactgctttctaggactggcccctcagaagttttctgagtgccagcatttatatcagtgctgctttatagaaggtccttgtctaggcctagctgcagcctctcccagcgttgctggggctgcccttccctgcccagaaaaaaggccagctattctgcagactctgctccctggagcctcacagagccagccctcacctgtgcttatcggttgcactagagaatcatgaggtgatgtcgcaatccacagaggcccagagagcctggggacagcatcacaagggtgcctcgcagcccctcttcctgacggtcactgtggacactccggcttttctcctctcctggttctgacctccctgagtgtgtcagaggctccgcttgggctaatgtgcgcctttagtgatccagcccgcatggtccatcatcccaccacaagcagcctgcggtgtcgtgtcctcccgcttccctttcgggcgcgttcttctcctggttgttgcagggtgggctgtctgggaagtagacggagacggaggctggtgtcatgacactgctcgtgagtggagcagccctgggtcagcggtggaggggtgggcggagagaagtcaggctcacctccgccggccctggggagctctgaggatgggatgggaggtgagtgggcctgcctgcattctgcgttggttgtcagacataggccacccagaagagggcctgacagccgtgagccacctgcctgtggtgcccccagcagctggggcaagaaaaccttgatcctgaaggggatcccggcccctccctcacagtgtcttgctgtaagagaaaatctcacctgccttacctggggctgctgttaccccagccccattttgatggggcccttgggagcggaggaagcgcagtgcagaggagctcttccacaagcgcacagcccatttgcaagaaacatgtttcctctcctcatccgggaaagtgacacttcccggccggctgtgcagagctcgtcaccaggccctgctgaggcctgtggcagtaaccgcaggtctggactagaagagagcagccagcggcacccggccactgtagcggtcactggtgcagccactgccagcagccagggcctccggcccagcccaggtacagcggagtgaactgtgttcatgtagaatcacagcggcgatgcccttaattgctaggctggggcagggaagcaccgccctggcctcctcctggtccctggcacccttctgccgggtgtcactgtgtccccatggttgggtttgacggacatcagggatgaagactgaagaagaaccaggccaggagtggtgaagggcagggctcctccagtggggtgcacagggtgggcccccgtgccgtcaccgctggccactgggcacacctgtgggctccaccagccacacagctagaactcgccctgctgttgccgatggcctgggtggctttggggtttcaccttcaaccggcagaagaaacattatgcgcttgaatttttttcctttttcttttttaaactcacacctgggcacgcatctgcgtactgccctggcgactgacgtgagcatgaagggagctttagtcagccgctcggcccgcgggaaggaagaggcgagcaggagtgactcacaccaggctcgggctccaggcttcctggcaaagcagtgaatgtgaacacccagggggcagctgtgccaaattgaagctgatttgtgctgaaagaagaaaacctcattcacagattacagaccagtcatggcccttctggtggacgcgtctccctctgcttagtaataggagttcctccagcgccacttgtgggaaatagaatttgaaggtggaaacagcactagggagggcactagccatctaatcctgtgtgacagcagtgtcgctgcagacttggcagctcagaacagcacgtggcctccagatccagttcctgttgtggggctcagccaggttctctgtgcagggtcccatcaggttaaggctgccttcgcagttgagaccacccgccgtccccaccagtggggtccttagcttggcctcccaccactcagagccagcgcaggagccgggtgctgcatcctcacctagtgccacacacagtcacagcagccatcaccgttgccatattctgctggttgaaagcagtctcaggtcccacctgcacccccagggaggggccacacctgggacaggggtcctggggccacgttcaagcctgtccacctcagctggtgaactgtgctggggtttggagagggtgagagtaaagtcgcagagcccagggagcaatctgaccacagctcccctgaggcacaccagtcgcggcgggtgaccacaggtggtcatgtaagaataggaattccagtgactgactgattaagcgcctgctgcgtgttgggctttacaattgttaggccatctccccctcacagcaggtactgccgcaaagctacgatttttactatcaatatgcccattttactgatgagaaactggggtgtgtgaggacctgcatggtagggccaggctgtggctctagccgtctagtgccagcctgccccatgctgacttagcggcgtacgtgctgagtcatgggatgtacgtgcatgagcttctgtttcaggcgcatccctgggacaggagtgcacccaggcagaagtggtgtttaaccagggaggaaagctcttgtcacctcttgttacacatggccactgtgctggcggatcacagcatcgttgtcagcgtgaggaagcttccccggtgtctgaacgagtctgatcaggcagagacgagcagggagtggcacttagcgacctgctgtagtcatgctcctgggagcatgctcctgagaccatgcgaggtctcaggaaggatgtgcgcctcatatgagaaacccgtggcaggtggcattccttgcattttgcagtcagctgcatcccacctacagaacagagccctggggttttccctccagctggacatgagaagctgctggggagtcagcagccctgtcctgggatccgagtcgtcttggtgactcccacgcttcgatgcctggccgagacccgcctggcttgggcctgcccttggttgggacctcactgacctgaggcccctaaccccgacccctgccttggctttacggcctttacagtgctggccccggtggccacccacctgcctgcccaccgtgctcaccctgcctttgaatgcccagcctctttgccccacaaccaatgtgacctggcttaggagcatagctgaagcaggtcgctaaggaaaaaccaagcaacgggactaatgggatgttctgaaagacaaggacaaatcaagccatttgtcagaacattggttataagagggaaaatttgggaataactctactacctaacagaataggaacgtaaattcagaacggatacttaaaagaaaatgtaagcagtcttaaaattttattcatgagtatgcaaaatatatgttaaatgagagaaacagaacaccaaattgcatcagcaatatagttaatatctatgttaaaatacatagtacacacagcaataaaacactaaacagatttataaataaacattaatgatgcttgtgccagggtggtacaattggagtgatggttctccattttaaaaattgatagatattactttggttaattaaaagtctgcctgtagattttctaagccttcgaagcactaaaagcaatttttaaaaatagagtctttatggctaaggcattattgttcataaattcagaactagagacacacagaagaaatcattacatacttctttacatgaggagaatcatgactggtagagtggcctaagaggcaggcgtgggggctttcagacagcagaaagacggggctggtgtccaggagggcgcgggcatgggtagggcagcgcccgggctgtgctcagtccaaccggggctctgcggggcggttttggcccacagttgccagtcatagagtagccaaaagttcatattttcatttttaattatctgattattagatgttgatatctaacgtggcattaaaaaacattctgcgagcccaaccagacacatccaacccgacacatccaaccagacagcggcctgtagcctgcctgttccaagctgggccatgaacccctagggacagaggcttcagtgaagccctcggtgcctcggctcccagcatggggggcggcccgtagacatggcagtgccgcgtgcatggagagggcggcgtccacggcgacttgtggccgagtctcaggatgcttcccccactcttcttcctcagcccctcctgtgcgtgtccaagggtcctctctagttagggatattttctgcaaggtctgacatcgtgtcttcttgtctttctatgctgggaagtgccaaataagtaatattaaagggttctttgtacagaaatcaatgatgatgtgaattcagggagaatcacttgcattttacacatgttctctggggtaggttttcagcaacaaggatgccagcgtgaatctagagctaaaaagtaaacacgagtcagttccatttaatgctgaaaattatatcatgagccaactttgatagggaattgaatgtaaaaattgggctttagatttggagaagatcctagatcctcgtaggagaagaaagactggaaatgtggtctggctggtcaggagccgggacagcaggtcccacgctataggtgtacacagattctccccgctggcttctctgttctgtggcatcttcctggtttcctggagtcagggcagctccactggcctcagtttccagagaacaaacctgactgaggtggacttgccaccttggccactgaccagttccgaccccgccccgccccaactccagctccacccagttctctcatttcctctcctctcactgccaccaaaacattatgtcaaaaaatgggggtttctcagtctgtatcagttcactatgtgtgcagaaaatttatcggaatgactttaacggtagtagaccaccccccaattctgagtgctgacagtttgtaaaaggccctttccaggtgctctgccaaagccactcacgcacggccttctcacggcgtcgggctgctgcgccccacggtgcccccgcgctgggccatcttgcacgggccgctgctgtccagtggcttcgaaaggagtttggtagttgaggtgagaccgcaggtgcgctgctccagtggcttcgaaaggagtttggtagttgaggtgagatcgcaggtgcactgctcctcaggaatggcagaggcttcccatgatggggagcatcattttcatcttttttttttttttcggaggcggggtctcgctctgtcacccaggctggagtgcagtggtgtgatcttggctcactgcagcctcaacctcccagggtcaagcaatcctctcacgtcagacccccaagtagctgggactacaggcacacgcccagctaattgttttgtattttttgtagagatgaggtttcaccaggttgctcaggctggtcttgaactcctgagctcagacaatcctcccaccttggcctcccaaagtgctggaattaacaggtgtgtgccaccgcgcccaatagggaacatcattttaaagcagctctttgcttcccagcggagattccatagcagccgtgtgttgttccgatgtgtgttttcccaaatgcgctacacaattaaggtgcttaggagggaggagaggcaagcacagaggtttggcttgcactagctccacgtccttcccgggtttcagaaaggcatgtacttgcccttgcactgcccagagaccaggccccagcactgcctcctctccattccccacggaggctgagacgattcctcagtccatgtcaccctgagaaaatccccctccaataaggcatttgattctgtggagtccgttattgcagaattttacctccactctgtcctaggcgtgttaacattcgaagtctaattctaactcttagacactctcaccacgtccttaacacgagtgagtttactagtctggacacaggagggaggcttctggaagactgggaaaccccaggccttcttagatatgagcagtccttgctgctcgtgatgaatttcatgcatgactttatcactgtccatcggaatcccgccgaggctctggaggcagagatgtcagatctctgatgacagtgaacttccacagagggcagcagcatctccctgtgtatccttgtgtatcactatgtatccctgtgtgtcactgtgtatccctgtgtgtcactgtgtcactgtgtatccctgtgtatcactatgtatccctgtgtgtcactgtgtatccctgtgtgtcaccgtgtatccctgtgtgtcaccatgtatccctgtgtgtcactgtgtatccctgtgtgtgcctgtatgtcaccgtgtatccctgtgtatcactgtgcacacagtaaaatttaacaagaagccagtccattccaccatgttaccatgttgcagatttagggaggcgtaaccacacagacttggtactggtcttgattgtggagggcctttatgctgagccagagatgaggaagatgttggtgcctggctataagggcttgagccaggtggatacggagggcatgcagccaacaccgctcttgagacaccggctgggttagtgtggaaaaactccattgaatggtttgcctttctccctggaggtagttaggtgtactagttgaaacacccattcattgggaacccgtgatccaggggctttacaaatgggcatgtgtgagcataggcagcataggctgccgtggccccaggtgtcagggtgcaggcggctcctgtcttggaggcttccatcccccgtggaagctcgtgctggccactggagcaacattcccgcaggtgggaaggccgcgaggagtggacgaggcagctcaggcctgggggacagacttggagctcacatgcccatcgcccccctgtcctgtggcagtgtctggtccagcctcatccagggagggagggaatgtggcctccaccttgagtggcatgtcccagctccaatgctgttccttaacaagggcagggagggaggcacaaaggagtgaggagtggtttcagacgctcagacggagaacattcggctcagaaacagaatcgtgctctcctctgttactagattttgccaactgcaactgaggactgagctgctgtggaggtgggctcctcaccatgggagcatcaccgggggctctgcagggctgtctgccacgaaaacaatgcccagagctctctcctcccctcatcaatagaccaaagtgtgtacatccccagggagcacacaggaaagatagcagaaaagagcatttggaataaataatgtacaatctagctattatactccttgggtggtgatggagaggttgaatttttagcaagaggaaagagggaacaaagcctaacaaacattgaggttaaaacatgaagtcatctgcatttacactttgcttcaggccgcggcagtaatgaatactcagagccggctttctgtttaatgtttgatgcaaagtcaccggggagtcattctccttcactttcaatttcaggggtcctgaaaccctgcgtttctctgcggtaataacccgtgctttccgttcccggggcgggcgcgctctgactgatcagcgcagatggaggctgtgcggacttggacttggacggttttcctccagcccacctcctgggcacccgccatctcagggctgtttcctgaaaacccagctcttgcctggatgacatgttttccaggcgagtgactcatcagaacagccaacagcttagaaagtccctctgcccccagctgctgggggggaggagcccacgatgcagatgagctggtcacagctaatcacagcctcctcccctcagatctgcactccagcactccagccctgcttctccaggcagcttgatcgcaggctgtgggaagtgctaatccagacaccttcccggtcccctcccaccttctgctgtcgtgtgctgccaaacctcacagggctggctgctgccgccgaagcccaccaccatggcctctcgtgtgtacgtaggacccactttcccacttgtctttagctgggaatcccaaattagagctgcaagtgtgtgttgattttaccgtagaaaatgcagccagttttaatcaacagataaatgttcattagagaataccgttgttctgctgtttaaaaggttgccgtgcaggccgggtgcaatggctcacgcctgtaatcccagcactttgggaggccacggcaggcagatcacctgaggtcaggagttcgagacccgcctgaccaacatggtgaaaccccgtctctactaaaaatacaaaaattagccaggcgtgtggcacattcctgtaatcccagctactcaggagaccgaggcaggagaatcacttgaacccgggaggcggaggttgcagtgagccaagatcgcaccactgcgctccagcataggtgacagagtgagactccgtctcaaaaaacaaaacaaaacaaaaggttgccatgcgattttagaatttaatgggtaatctggccctgtaatttggttaaataaataaataaataaaccacccacggccccgagagggcctctggcttgctcagcaggcggtgccagggtgcaagctcctcccagtacctccgtcttccctgccttgctctgagtggggctgtccttcgggcccaggccgagctgtggcttgaggttcagggccgcttcactgtgtgctgataatcgggttccagcgcttgtctttcagcggtttgtaggcgttcttttacatcctttcttctcattagtacttgaacaaagttattttcctcctctcatgtagacagctctgcctcgagtccacagccctgggtagccggacggccccgagcagcctccgtgcatcgtctgggcgccgagccacagcccttcctcctgggctttgtgtcatccccgcagcctcctgagcctctgtgcatcagtgaaaccagaaccatctggggctgcttttctggtctgaaatgtggagctgggtcagtccccgcctcccaccccggggctggatccaagtgggcccccagccttttaggagcacatgtcccactgcagcaacatgggtcacgtgtccgagagagattgtcacccgtggctctgacacagctttgctgggcggcatcctgtccggtgtgctgagcgatgtctccagtgcagttcaggccttcaacaccaagcgagggccttggagaacgtgcgaataggctttccgggaggcatggttccaaaggcgccttgcccagcactgaccgaggccacaccaggtgccacgctggtctgctcggcccacggcccggacaccctctctgccctcctctcgcctccacctcccctaacttgcacacactttcttctaactcctgaagcagaaactttttatttgattaaattcgaggaatctttatagagtttaattgcaataattgactttgcttctgtcttaacaaagagtaaaatctccctcaatgctgctgaataccatttgcctgcagctggggatttactgggcatatgggagctatttattgcacgtactttgaggccttttgattatctcctgattgcttcttaactctgttggcaggggaagggcatgtttgtgcaaagagggccagtcttgggaaaattgaaatatatttcatatatttgaaagtgaaaaattgctctttagtccctttgttcatcttaaacttttacttttttttctggattttaacatttttcattctcattttggtcctttactaagacattgagaaaatatgccctttgacacggcagcacggagtgtcattaacctaaaaaataacacagagtcctcgagtctcttagaaaattacccaggagaagagagcgcagtgctagaagcagaatccagtatactgatcatcactcggtttccacaaggaacatatttctagcagaaagggagagtagggctgaagggattgctgtccttcctccatccctacgacgaaggttgagtgtccctaattcaaaaatccaaaatgttccaaaatccgaaactctgtgagggccaccacgctgccacaggtggacagttcccctcccgaccttgcgggcgcaaactttgtttcatgcacaaaattgtgtaaaattcgcttcaggctgtgtgtgtaagaggtatatgaaacatacatggagtttactcttagacttgggtcccatcccctgatatctcattatgtatatgcaaatattccaaaacctgaaaatatcggaaacccaaaacacttccggtcccaggcattttagagaagagatactcaacctgtatccgcggagatcaagactgtgttctgtggctgtgctgagagcgaggtgatgattcacttccagttgagagttcatgttggatgttgtggcggggccacagcagctgcctccgactgacccctgctttgtgtcagccgctctacgaggacgctgtgagggaggcatgatcataagcccatttcacagatggtgaaacggatcctagagagagagccacgcgcccagagccccagagccacacgctgaatttcaccaagcagcctcccacacgggctccctggtcaggccctcatcctccgggcgaggcagcgaggcaggcaggtcagccgctccctgggccggagctagtgggtagcagagctgggagcagagcccaggctcatggctcccggtcagatcttttcttccctctctccttctcgaaagtcacacggggctgctcatgcacagagggtgctttcctgctcgccctcactctcatttagccaatgcatattgaaagcctgctatgtgcctggcactgggaaagaagttgggtacggctggatgccagggcacctgcaggatgtctgtaattcagcgtgtggctctgcggccttgggcgcgtggctgtctctctagggtgaaacagtctcatgatcatgtctccctcacagtgtccttgtagagcagctgacacaaagcaggggtcggtcagaggcagctgctgtccctctgccacagggctagagatgtcagaggtgctggggtgtgccaggcctggggtaccacgagaaggccagagccacagaaaggcttaggggggctgtgttagagcctccgagaaagctcacagggcagctggcctggagggaggtgccggcagaggggcccattgggagggggctgttaggacaacaccgaggctctgacaaggccatgtcaggaaagtggcgatggtggctgggggtgccccataaggctgttgcctacacctgggaatcccaggaactggcctggaggtgtgaggtccaattcagactgccggctgttcctacagtagaattggggtgtggagctctggggagaggtgtgaggctattttaaatagcgtctgggggtgtcggtgagcaggtggcattgggcgccctgagcaaggatgagagcaggcagggaaagggctgtggaagctgcagcagtgcggccctgaaggacggggtcgggagcccggggaggaggctgtctcacgttcaccgtgacgggaaggaggccggaggagaaagcctcataatgtccaagggggagaactcaagagggacagtgtggtcggttactgtgacaaggggtctcgacaggggaagcacatcaccggggtcatctgtggagccactgtggcttggggggagcagctctatgcatggtaggagaccccagactgcagggtgcctggtgagacccacagggaggcagcaggaactgactgagcaggtggctgtccacaccagggagcagcaggggggaggcaagggagggacagggaggggcctgacggcaccatcacagcgcagagctcagccctgaccgccaggactcctttccctgactgcatgccgacccctcctgatgaggcactttgggcctggccctggtgtctctcccgcgtccctccaggacgctgccccatcagagcctgcgcagggaccacagctgcttagaacacgtgggctgccagtacatgggttcaagtcacagtcagaagccacagcagaaaatgggaagcattcctttatttttccaggctttttttcttattttattttaaagagaaaaaatgtgacaaaatggtgaggatgctggcagcgccagcgttcccggcctgcactctctcctggcctcccctcggacgtcttctgcagcccaaatctgaacagcagtgaaaccgtaaacatgccccccaccagctgccgtggcctccgcccagacccttgctgcccaggctcagccggctcctcctgtgccctgtgaagtggcctcgtgtggaagcccgtccataatgctcagtggatttcctctgttctctccgcaggcaagcctgggacctggctgttgacatctgtctgtctcagctgccgacgatcatcgaggaaggcactgcgtttcgggtgagtccctccaagggcaccctgtgcatccgcggcggcagccacttctctgggcacctggactgcaaagcccccagactgggggtggtgcccaggactctcgggtgtcagattttgttcacctgcctggaaaaaatgtagttgccagagtttaaaacatcgagtcaaccagggtttaaagttaaactttgaaagaatcaacttttaaaacagtcctatctcaaaattttgctattacagatctacttttcttaatgcggactcactccctgtgagtggtgatcctgttacactttctagccttttcaccacagacgcgttgtggatctcccccaggcctctgactctcagccctgtgggacagtgacccacggggggtttggtgctgaaccctggagggcgttctgcccccggccgcactgcacgggcgctggagagctgagccaccctacggcggaacctgggtttagtcgccgcacctgcaagtgagggtggccccgggccttcgcggcagctccctaggaccccctcgtggtttcttaatgagcttttgccttacgtgaggcgccaagtctgaaaatagataaataagacggaggccctgccctccagaaacccgtgaggaaagaggagcctctcacatctgtgcagaatgcaagggagcaatcggcaagagggcgcggcagacacggggaggccagggatgggggaggcggcagcctgggcagaggcaggaggggaccagcatccccgcctcccgttggggccacacctgagacaccaccgtgtcaggctccagagccacagagcctagctttgccaccgagggcaagtttggtcgtctcctcatttaagggagggattatggtggtatccaaccccaggggtgctggaaggacaaagggagttaatgtaagaaaagtgctttggacagagcccagcacagggcccttgggaattcatgtgcaggcactgccccagagccagctgtcactgatgtgaggatgccaccctccagcccagggcaggggcaccgatggtcaggaaggttccgtccactgcacagacttttaactttcagtgcacaccacagccgtcagggaagcttttaacacatgcagtcgggagcctgggtgtgcctgcgtgcgtgcgtgtgtacgcgtgagtgggtgtgcatgaggtgtgtgtgatgtgcctgtgtggggtgttttaactcctcagatgattttgacatgtcccacgggtgggatgactgggaaaacggccttttaagagggctttcttttttataatcttctgttaccctcccattattgcttgatttttttggtaacatttgattgtgaaaattttcaaacctacagcaaagttggaagaaatttacagtgagcaccccatgcccaccacttacttctaccccatctttgtattcatggggtattttcaagggcattgcagaccgccccgcattttacaccgtgaggcggaagccagctccccgtcatgtgcttggcatcaacactgggcttctagacaaaggccttccctcccttcctgctggaccacaaaccttggggggcaatgacagggtctcctgcagagtggcaaaccttcacagacgccagctgtccaccctcagcctgccagagctgctttcagagtgcctgcgcttttccgaagagctctgggcctgttgccgcaaacagatatttggaaaccttcgggaaactggcctttctgtactctgagcgtggcttcactcggtacttttaagagatcagaataatctgctcttatataaaataatgcagtttctatttgcatgtgtgctctttctaaacgaatacttaggtttctgtgccaggtatctttgccaagtttcttttcaaggattttactctatctatgctaaacaactagaatcaatattctgcatttgggaatgatttcaccatgttggggtgtcaggacaagccggggataactgacgtggaccacacactaggttccttttgtttttaatcttattggaggtgtaacttacatatagaaaagtgtacacatcatacacatacagcttggtgaatgtttcaagctgcacatactcgtgtaatcacacccaaatcaagcagccccatgagccccctcggcgcccctcttagctcctcccttccccagcagtggccgctttcctgcccagttttgtgcttggatgcgtggagtcacgcagggtgtagtctttgtgcctgcccgctgtcactcagcattgtttgagtaagctcactctctctgcaccgcagctcacactcaccgcacggcagctcactctcaccgcacggcagctcacactcaccacacggcagctcactctcaccacacggcagctcactctcactgcatggcagctcacattcaccgcatggcagctcactctcaccacacggcagctcactctctttgcaccgcagctcacgctcaccgcacggcagctcactctcaccacacggcagctcacaccacggcagctcacactcaccgcacggcagctcactctcaccgcacggcagctcacaccgcacggcagctcacattcaccgcacggcagctcactctcaccacaccacagctcactctcaccgcacggcagctcactctcaccacaccacagctcactctcaccacacggcagctcactctcaccacacggcagctcacaccacacggcagctcactctcaccgcacggcagctcactctcaccacacggcagctctcaccacaccgcagctcacactcaccgcacggcagctcactctcaccacgccgcagctcacactcaccgcacggcagctcacactcaccacacggcagctcactctcaccacacggcagctcacactcaccacacggcagctcactctcaccacacggcagctcactctctctgcaccgcagctcacactcaccgcacggcagctcacattcaccacacggcaactcactctcaccacacggcagctcactctctctgcaccgcagctcacactcaccgcacggcagctcacattcaccacacggcaactcactctcaccacacggcagctcactctctctgcaccgcagctcacactcaccgcacggcagctcactctcaccgcacggcagctcactctcaccgcacggcagctcacactcaccgcacggcagctcactctcaccgcacggcagctcactctcaccgcacggcagctcactctcaccgcaccgcagctcactctcaccgcacggcagctcactctcacagcacggcagctcacactcaccgcacggcagctcattcaccgcacggcagctcgctctctctgcaccgcagctcacactcaccgcacggcagctcacaccgcacggcagctcacactcaccacacggcagctcacactcaccacacggcagctcactctcaccacacggcagctcacaccacacggcagctcactctcaccacacggcagctcacaccacacggcagctcactctcaccacacggcagctcactctcaccgcacggcagatcactctcaccgcacggcagctcactctcaccgcactgcagctcactctcaccgcagggcagctgacactcaccacacggcagctcactctcaccgcgccgcagctcacactcaccgcacggcatctcactctcaccgcacggcagctcactctcaccacaccgcagctcactctccccgcacggcagctcactctccccgcacggcagctcactctcaccgcacggcagctcacactcaccgcacggcagctcactctcaccgcacggcagctcacactcaccgcacggcagctgactcaccgcaccgcagctcactcttaccgcacggcagctcactctcaccgcacggcagctcacactcaccgcacggcagctcacactcaccgcacggcagctcactctcaccgcaccgcagctcactctcaccccaccgcagctcactctcaccacacggcagctcactctcaccacacggcagctcacactcacggcgctgcagctcacattcattgcaaggtggacaccattgagtgtcccaacattcatgtgtcccttctagggccactgggcattttcagttttcagtcctcactaacagtgctggctagagccagactctgtcacatcagagcctgagacaaaagggaattctgtgatattggtcctccctttgaaatgtcgatatcttcttcagtatggatttttgtattaatttttatttttgtaaatattgcactgaaatatcatttgtcttgattactgatttttttttttggtaccccacctgctagcaccaattctgtgcctgaggccaaggcctccccttcctggctggcctcccgttcaggggctgctccctccttcacatttctcggagtgatccttcggggtcccagggtttgcccatattcagctttaacagatggtgccagagcactctgcaaagtggctgagtcagtttacactcctgcctgcagcattcgagagttttagttgctatgtatttatttggctatgatggttcagtatgaaaaggtatttccttaagagctaatcgtgtatttacccgatggttaatagagcattgttctatacttgtactggccatttatggttccggcttttggtatcctgttttatgaaacctttatttcctctgagatgagcattctgagcagacgctacgctctttgtcagctagcagcttgtgtgtttccctttcacatctggacctgcatctgctcacatttcacgtcccccgtgaatgctcggcttactggtggtgtttgcactgaggaccgtgtccgcgtggctccctctgttccctcctttgcaccaagggccatgttcacatggctgcctctgttccctcgtttgtccctttgctcacttgttctttgcaccaggaccacacagttgtaatgacaaactctacgtgacactttctaagctggtagactaagtcccacaacttcgtttttttccccgagtttgcctcagttacttttggtcctttgcatttccatgtgaattttaccatcagtgtgttaatttctgcaaagaacctgctggatttttgttgagattacagttaatctacagattgatttgggagaagtcaccacctctataatattgagccttctcctccctcaacgtggttgtaaatggtattgtttaaaatttcactttctgatttttctctactaacagtgacatagaaccctataaaaattgaggttttcagaggctgaggcaggagaatttcttgaacccaggggcagaggttgcagtgagccaagatcatgccactgcactccagcctgggcaacagagtgagactctgtctcaaaaaaaaatttttttttttggtttattgagatagtaggagaagccagaatgattcccctgcagtagaaagctcgggctaattgactttcttaggggtgttaaagagaacccttctgcaaactgagcagccgtacagggggatagaatgtccctacagagccgtacaggggggtagaatgtccctacagagccgtacagaggggtagaatgtccccttggcagtgaactttaagtcccctctttaagcagcaagcttgtcgtaagtggcaaatgtattgtgccattgtcaggacggagagtagccatctcagaatgtccagatggtgagaaaggcggcaggtatgctcaggttgttggtagcagaagtccagccggacgggctccacttaggtgtgacttggaggctcccagcctctcagccggccttcccattttcagtctgctgcccctgtttttagaatatgtcaaactgcctagcacacaggctggcaacagagcaaaactcctggcatccaaatcgccctgggagagccaggtatgtggtcctggccgggcaacccagacgctcagcccagcaggacctgtgagctctctgtctcgctgaatggacttcgctcccctgcacgcaggggccagctcaggagctcttcatggggtggagaaaatctcagagatttggcccaaaacatcagccctgtgaatcatgggtggagacacgggccgctctcgagatgttttccggaatatcatataaagtgttggccactcttccgcaggcgcttgctctaattcgtcagcctccccgtggctttagggagcttcacgggcttcaccgcgcacctgccaggcaaaggtgtgcttttccttttttgtcagtttgaggtgaatagtcaggaatttttctctttctgcatggagtagtgactccagcagtgaggaacatgtgaaaatccatcaggcaaagctaatgtgatagaaagaagaggtgtaactatctgaattacctgacttctgttcacagactcaagccttctctaactcaggagaattacgttctcgcgggatgtggaggagggggtacttaacgagatttttttttaaccaatttatgaataattcacacttgaaaacaggaaaatcactctgggggctccaagccagctccacaggttgccctccaagtgtgattaactttctgtaagctggctgcacaggagcacggattcctacgtggtgaatgttctcggctgactttttaagtcgggccacggggctctgcccgccaggctcctctgtggaggctgccgagagcgctcctggacttgggcgcacggaggcaccctgtcctgctcctggcgttcgcctgtccacatgtgtccacattcactggaacccggggcacagccgaccccggccagatgagcggagggagggttcctcccgacctcctctcagagacacgcacctccactgcggccacccaccttccccccgagcaaaatcaaacaacgtagggaagagaggatagtggatgggagagagaggctggtagttgtttttttttttttctttaattctttgtatcgggggctcagggaaggcagagctgtgtgttaagtggaagtgactctccgtggagggaatcaggccggactgctcctgcctggccgctcagttccgagaccttccaacggcagcctcccctgcagccttcacgctctccagccgcaggcccagcagccctgctgcccacctgctccatggcacccaggcgaatccccctccactctgtgcctgcactcacgtggctgggctaactgggagctcgggcccacccggtgtggcccacggagaactcgtgtcaccccctcgaggggccctgatgccgcctgacattctgaccccaagcattttttttggtctccctcacccgcgcgccttctctgtccagctgcaacccctcctcccgccctcaccccagagagtaccctcgtttcccatttcactgaggaaacaagaagcagtcgcatgaccgcctctgccgggtcctccagccctccccctgcttctctgcatctgggcccccttgctttgccgcctgcctggttcccctggggagcagccctgctctgccagcccagcctgtgcttccagtcccatcccccagcctgcccgaggatgccctccagcagcctttccccaccctccgtgcccccagctgggtctttctcaccagcgtcctgtccccattactccacatctacaaaaagcacttcctgaccctacatccctctccagccaccacctgtctgtcttgttcccctttgcaaccaaaaccaaattcaccctgtctcgaaacccctctggctgcgcttttgcccaactccagagcgttcttgctgctgatccggggcccagtcagctctccatccttatctcgcctggcccggtgctggtttgtggctctgccctggacgttgctccctggcgtccagacctttgagctctgctttccctccactgccgggccctcaccggccccagcgcggccccagctcatctccttggtctccatagcagaggctctgtcctgggcccctttcctttctcacttaacttgaaaaagattcacacaccatgactcccaagcgtgtccccagccagacttgcctgctgatccacacactcacggggtcccctgcccccggcatcttcactcccttgtccagccactgtcgtgagcaccacatgtccacagctggttcccagcacgctcctcttgcggccccagctcggtgccctggccaaaagccttggagtcatcctcagctgctctcttctcctgcctgcctctggtcccttcgtgcaccccgcaggctctccctctttggcatgcccagagcgcccgcttctcagccgcctggcatcctcgcggccctgcagggcgggcccttcgtgaaggcttggatgcccggcaggtggcaggggtgggcaagaccaggccatctgggaacatggccctaacaagcacctgttctgcttgccccgcagcacagcccgttcttcgccgagcagctgaccgcattccaggtgtggctcaccatgggcgtggagaaccgaaacccacccgaacagctgcccatcgtcctgcaggtgagtttcttcagaccgggccagacagccgaggttcctcaggaaggaagccagatgcctgtacagccccgggagtgccttctctctccctgagccctgtgggtctgtgacatcccagcccctctgccccgaagatgatggtgcatgggcaggtcgcattcgggcaaacggatcacacagatccaatcaggagtcactgggctgatcgcacattcattcctaaagggtttcctctaaagccattgatttccctcctccaccctcagataagtgtaactttgggactggggagtcatcagccagtccatcatccccctctcccctggctaccatttccactttaggaattgctgagattcagctacagatgggctttgcttcagagcaggctctcgacaccactgcctccttctcttgggaaggacaggagatggcagtgaatccgggagaggagggaggaggctccctgagcggatactgaccggcgaagcgggcagagcggctttgtggcccagcgccgtaggttatgcactgaagcacacacagatccggaagccggcagcccttcccttgcacggggctgtcacagctgctgtaacaaataggcccttttggggcacgtccttcagatgccagtgcccacggggcccgtgtcatgtcagtgctgttcacgtgcagaccatgacctgttcatgggttgggaggtcagcatcgtgggtcctgctggctggtttttggtcactgagataggatgggaggccatggaaattgaggagttcgtcacaggtagtgaagttagaaagattccacagaacttttgtttcggtgaatgtgtgtttgtggggaagtgtgtgggctgagtcagagtcaaaggagtttaaaatccactggtcagtgtagatatcaaggtctaagaactcactttaaaagctggaaaagtgtttttgtgattggggtggtgcagttggactttggcgaggagctgtgcatggccgtggggaggggctgcccagcagcaggcagggaatgagcaggccccgccctttttggtttaaagctgggtgactccccccacacacaggaagagccccacctccgggtgtggtgctgagttctgagagtcggcagagttgggtcctcgccttcctagaaagcagatcgggtggtggtacctccatggagaggggcgtgagtggcgccgcccacctgcccttcttccttccagagctcgtgctttctggttagggccgctcaccacactgacagacagcacaccaatcttcactagaccaggtgttcatcccacctctgagagatcatttagaaaaccggggccagtttatctctgtcacggccatggcctcagcagccttcccttccgccgttcagtctgtgctgcagcagtggcagccagcgtcgcaggcgtgctgtaggactgaggcttcacctcgttcaggactttgccccaagaatctcagccagagaaagaggagttgggagaaggaacagtgcacatggacgtgctcaagacagtaccgccggcctgtcctcgccggcattgtctcaggcgggcaacaaagaaccagtgtgccagccggctgccctggtgttatgatcccagctcctcagtaggccaaggcggggaaggatcacttgagcccaggagttcaaggccagcctgagccacatagggagactccatctctacaaaataaaataacattgtaccacatttcacagtatatatttctgctgctgtcagtatattatgacagttgctttttggacattgcaaaaagaatgcagacgttattactgttcttcctgtatgtacctagattcgtttaagactatcctgagattacagggtgaggtgtaaacaaataaaccagctcatgttcaaaaccaagaacacgcagtgatagcagcaacgcaaccaaacaacatttgacagaagcccacgttttcccttcgtgcgactgtagaaaggcagctggctgtgtggccacgggtgaccgggggtggccacagcgcaggttgcccatgctgggccccacggctcctgttggtcatctgggttaccaggatgtccctcaggagacactggctctcttactggccttcctactatttgagcaatgtgatggagtaaaatcggccctctccaaagcaggacccgatgccaagcacgttaaatccagttcttttgggtccagcaaataatctttttgtaaatggccttctgttgatttctttcaatgttcccttggccacccacactccctcaaggaaggagaagacgtgctggaggcagctttctgatggtgacgtatgcgaagacagctctggtcggagcgtggggcatttcccacatgattttccagcaggtgtgagtggcaggttcctcctccctctggagggtctgtttcctggctgtgcccagccgggatcaatgggcggacctccacctaacacaaaagtagggaaagatgaagtgtaatggggtatcggcttcatttgacgtaccccccgggagtggcttctttctcgttaactcggctcacttccccgcgctttctcttaaaagcctttatttttgccaaagcctgggccctgttatccttaaattattctctagtgccttggcaagtcagaaaacatcacttaagggaaagggagttttctcactcgcttccggttttccgaatccctgccacttcatccctaagccagaggcagtggctggtggccctccagggtcacgcacggtgtctcatcaggtccggctgattcgcagcccctcctgtaaacgtgagcatggaacaggcccttcctgctttccagcctcaatatcctctctgccttttaaaaatataaatcaacagaggaacaagaaggaagatacaatgtttaaaaaaattgctgttttgcccagacccttgattgatggtgtctatttttttgagatggagtctcactctgttgcccaggctggagtgcagtggcgcggtctcagctcactgcaacctctgcctcctgggttcaagcaattctctgcctcagcctcccaagtagctgggattacaggcacccgccaccatgcccggctaattttttgtatttttagtagtgacaaggtttcaccatcttggccaggctggtcttgaactcctgaccttgtgatccacccgcctcggcctcccaaagtgctgggattacaggcgtgaacgaccgcacccagccctgaacaccgtcttctcacgaggagctctggactctcgtggcctgtggggtgcgtttgccctctggcttcggcagctcgcccggaactcagtgctgtgtgcccccaacaggtggctcaggaagcccaggcaggggaacgaagagcgcctaggttatggaagagaggggagaaagtgacttttcttcttctttctttttcaggaaaaaggtgacagtgatatttatgtgttcatttatttacttggccctttttcttttcaatagatccagggtatacgggtgcaggtttcttgcatgcatgcactgcgtagtggtgaagtctaggctttgggtgaacctgctacccacatagtgggcattataccccataggtaatttctcagccctcagcccctcgcaccttttggagtctccggtgcctgttattccacctgtgtgtccctgtggacccgttgtttagctcccactcacttatacatgagaacatgcaacagttggttttctgtttctgagttattccactgagcataatggcctcctgtttcacccatgttgatgcaacagacacgatttcattctttttctggctgagtagtattccatgatgcacagacgctgcagtttcctcatccagtcctctgttgaggggtgatctcggctcactgcagccggagctccgcctcctgggttaaagtgattcttgtgcctcaacctccagagtagctgggatatcaggtgtgcaccaccgcacctggccaagagtgattttataggatgaagttttagtcccttttcctagatgtcacagatcagtgtgagcatttcattaggaggtctatttgctctctctccgtgcatcattttttttacaaatagaatgtggggtctgaaagtacaggattgttatcaggtgacagcagaatgacaaactagagtgatgttatacataccatgtacatcggggactccaaaaccgccctgctcatcaggtgcccgaggcaccctggcctgcagcacctggcactccagggctggaactggagaatcttttcttatgaagcagctcttccagtatgcctgtctgagcactctcttcatatacaaggcaaatgaaatttgataaccttagcaattctgttttaatttggtcgcctcagctggagtgcagtagtatgatcatagctcgctgcaacttccaactcctggggtcaggccaccctcctgactcagcctcctgagtagctggaactgcatgcatgtgccatcatgcccggctcatttttgtattttttgtagagacggggtttcaccatgttgggcaggctggtctcgacctcctggcctcaagcgatcctccagcttcagccttccaaagtgtttgcattacagtattgagcctctatgccggccaccatgattaatctttagtttgggctaccacaggtggaaaataaatctcagtaactcattcagctcaccatcatttacttctataatttccatagatcgtgggatggtccggaacaggaggtttttgttttgttgtttttaagtacagaaacaacattggctttttttctaaaagccaatcccattttaaaaataactttgctttatgttggcttcagtttttaaaaatcgtaaatcaacaaaaggtggcaggaagatgatgtaatgtttgagaaaaaaaaaacagtacttaacctttccgccaatactctttattgacgatgtttctttgcaaatgaaataattgtagcaccaaatcccatgctgcccaaggacctccgacgccgactcccaggcaggtgggcccccgaggcccccgcgtgtgtttcatcagcacctgcagctcctacagtgggacactcgggaccacatcacggtggtgattgtgaaccagcgtcccgcttgcttttgttgtttgtaaggagcacattctaaggagacctttattgctgggctagtgtcctggtaaaacagtaacaggaactggccttgattagacctcttcgccccgtcctgccactttttccatttgttctgcaactatttaccttagaaacagccttgtccttatttacagtgttggaaaaaaacaaaaagaatcagaaaacaatctttgtaagctttagatctgatgatgtctttgatttctgacgattgcagccatggcgagacctgcctcctctcctctccctgggtcatctagaaacttgagcctcaggcagcctagtgttccctacacacagagagtcagtccttaaaaccttgggtggtggagacatctggtagccgaacactatgatgctgactttacatccgctggacaccttggtgcacacagctttgtgctagacgctttacggactctgcctcattgaactttgagaataagcccaagtcaagtactgttgtctccgtttttcttgataatgatattgaagtttccagaagttaggaatctaagccaattattgggcagagatggaggcagggttaacatcaggttagccggccccagagccagtgcttttcctccgactggcccctcaaacctgagttccaggcagcagtggcatgcgacagcccccgagttaagcataggagagggatccggttccagttcacatatcctgcgagcagtcccacgttcctttcccagcctcttaatcagagactctcagcatcaccagcacggggaacctgccactcctgggtccatggtgaacccagcgtgggagctggctccgggcacatagaagggaagtgaggccacattcccactgctctttctctgcccccaaggctggacatgctgggatcccctccataccccatctgcccctccagcctggctagccacctcctcttgctgccacctgtgaccttccctgtccccctcatcctcctgccagtgctcttctcccaccacagggaagctcctccctctccacggctccccagggcccatgctcctgactcggtggctcctccgtggaagtcgtgctggccgacccccaggagcttgacccaggtggccgccatctcctctcccctcccccgatcctccaccctcactggcctcctcgtccctttcccctgcctctcttgagggttttcaaactcatcccaaaccttcttttctagagtttgctttccttcaccccttcttctctcagcctctggccagtgctgcagtctcctcctccccatctccgtattggcaccctggtcaaacccacccccttccactcgcctccccgacttccagcctcttgccaggcctgtccccaaagcgagcacactggaccagtcactgctgcttaacgtcggctggtggcttctggatctcaaaacaaactgacctctctgcatgccgtcggcggggcctttccctatccggcccctcccccatcactgacctcagtcatactggtagcccgtgcatcctcagacacccgggcttttccagcctctccacctgcaacgcggtaaccccctcatgtcacctccaggacccgctgcccagctgtgtcctgtgcatcttctcctggggggagggaaaacctccgaggcctgcagcgaggccaggtcaggggctcccagggtctgtgtgtttaggcatggtgatggggcggtcatttgtttaatgtctgtctcccaggccacatgaaggatgggtgaggtggtccctactgtctgtggtcactctcctagcacccagcgcagcacctgccccataaacaccccttggatgactggggcatcgtggatagaaatgctgtaggttggagggagtcgatgcacatgccttccagcatagccaccattaaggaaaaaatcaaaagaagtaatgccattaaaagtgtaaagcttggccgggcacggtggctcacgcctgtaatcccagcactttgggaggccaaggcgggtggatcacaaggtcaggagatcaagaccatcctgcctaatgcagtgaaaccccgtctctactaaaaatacaaaaataaattagccggtcatggtggcaggcgcttgtagtcttaactactcaggaggctgaggcaggagaatggcatgaacccgggaggtggagcttgcagtgagccgagattgcgccactgcactccagcctgggcgaccgagtgagactctgtctcaaaaaaaaaaaaaagtgtagaactttaatataacagaaaaagtatgtgcaaaacctctggcagagcccactctaacttataaagaactctgacatgtcaataagaaaaagccacattttgaagtagaaaactaaacgcatgcagggcaagtttactggggaaatggcccatcaacctgcaaaatgtactccccttgaaatccaagaaatccagatgaaaaggatgtattttcacctgtccttttggctaataatagtgtaatatgggctagtattgtcccacaagctttaaatttattatttaatttaatgaaacccttgtgggcaggtgttgtgttatatgtgttttatgaattaataaatcaaggctcagcgacgttaacttgcccagagtcacaccgcagtgagcgctgctgggtgaccagctcaggcagcaggaagctggtgcccacgtgcgtgccgtcgagagtgtgagtgggttcagcctcagggtcatttggtaacttaagtatatatgctccgaccttacctttttaatactcacatttatcttagtggaaaagaatcatgtacatgtgccgatgtacccattaggatattgatcacaatcttctttatcagagcagcattttggccaggcatgatggcccacgcctgtaatccctacacttcgggaggctgaagcgggagggttgcttgagccagaagttcaagacctgcatgggcaatgtagtgagacccccatctctataaaaaatacaaaaattaaccaggcatggtggtacatacctgcggtcctagctactcagggtttgaggtgggaggatcacttgagtccaggaggttgaggctgcagtgagccatgatctggcatctatactctagcttgggcaacagagcaagaccctatctcaaaaataaataaataaaaatggtaaaagtaggaacattttgatgataatttaaatatctatcactggggaagttgtttaaaagaattgtgtacatttgcataacggaagtactgtgccgcctttgggaataatatggtcagtacatacctactgatatgaacaatgttcacagtgcattgtttagtttaaaaaggagctgagaaatagaatcacatattatctagttcaagatcagtaagagaagtgtggacataaagaacaatgtctgagttcatatacctaaatgtcaccagtgggttagctttttaaatgcaattaaagcatgtttgttctagtattttctacattgagcatcttttatctgtgtaataaaggcataaagcgtgttttcttcacctgtctaaaagcatgaacttgtaaggaaaggagcaccagctctaggtaactgaagcagcagacagatctgaactgtggtcagaccgctccaaagctggcagctcatgcagcagcgtttcggggttgcacaccagtatggtttgcagtgataccattttcttcttgttcttccaggtgctgttaagccaagtgcaccggctgagagcattggacttgcttggaagatttttggacctgggtccctgggcagtgagcctggtgcgtgccttccgcattaacctgggggctgagggaggtgggacagagattaggctccgtgtttcagtctgtgcacgtatttcatgatccagagccacccccagccgtgagacccagggcgagtgtgtccaccgtgttggtgtcctgtcactcctgaggccctcaaggagcccactctgtacccgtgcagcctgcagtgctgcctggcgtttgggggtctggggttgtcgcccctctttatgtctgatgttagacataggagtgagtgtgttgtcggccggtcaccttttcctgagccgcccccagcgctgcggaggagcagggcgcccctgagcctgacgcagcacccacctcgtggtgctgcttcccccaggaggagtctggatcctcagcactgtctgctcaccatcatggcaggcacaattcggaaacgctcttctggttcctcattctatagcagagtagtaatggccactaaaaacaccctggcagaggcaggatcaagaagcgacgtgcgtttaacaaataactcacagggaaagtaaaaggaggctgagagggaaccacagagtcaaggaaactcgagagacctatggccagctgccatgtacagtaaaccttacttggttctgttgaagttccaaaaatgaatactcataaaacaattagaaattttacaggtgctggatttatgttattcaagaatcattgttcgtttttcttgggtgtggtaactggatcatgtttttataaaagagacctaattttttagagatagacactgaatattcaccaatgaaatcacatgacatatgagccttaatttactgtgcttgggagcggtgcggtggggcggtgggtgcggaaccgctgtcactagctgggtggtgagtacctgggtttggtgtatttaagtattttcatcagataatgttgacaaagagtggtaattgatagtccagcactgaaggacgagagaaaacatccaaaacttggaagaatcattcagcactcaccactgggccattttcactccaggtgcctgaggccacaaatagcttgtaacagagtcagggcctgagtcatcggaggaaggctggcgtgactcggtcacttggtgtgtgcgtggtggtgtcgcttagtcatcctggaaaggcctgcgtggtattgcgtgcactctaagaagacaggaagcatgtattcataacagtttagaaagagtttcatttttaaggttaattttttaaaaccagtttcttccctttaaagaattaagcttctgctcattggaaatttgcctaatacatgaatcgaggctggataaacgaggtatttttacaggtacagattttgcctctcaggtgagggcccagccacccgaaccagagaaactgctcataccttgttaaatgtggcctttcacagggaagggacccaggcctaggtcccaccaccacctcctgtcttggttacaggggacctcacttattggaaggtgatacctttaggatatctttgaaattccagcagctttgagataaggacacagcagaaacccctggctgtggagtgcagcagtactttgccaggcatcctccacactgcagtgccctccacgccctccctcccctgcctctgagggcagagagtcccctgagaatgacatggccagaactgggcgccagtgagcccctgggcaacccccgctcctccctgcctttcccagggcaggcatctttctcccaaggtgtatctgaagtgcaaacatgagtgttgagcaagctggccgtgccgtcacggagaggtggccgtggtgtcacggagaggtggccatgccgtcacggagaggtggccgtgccgtcacaggtggccgtggctcgtacgtgagcaacacagtgaaggtgcctgatgctctgctgccaagagcagacgaggccactgagggcaggcaagggccccaggcgcaagcagcctgcgcctccacaaggaaaagctgccacccgattcattccagtctcttgacaccagtcaaggctggcagtatgtggcagcttctaggaataaatcagagatgaataaatctggaggaagcccctctttactttaagtgaggcccattcattcctgttgcgtttcccatatgtgctgaagatagcaccgcagctggtcccgcgtggcacccctgctgctgcccgttcccttgctgcggcacaggtgcgctgacgccctccctcgcccccaggccttgtctgtcggcatcttcccctacgtgctgaagctgctccagagctcggcccgagagctgcggccacttctcgttttcatctgggccaagatcctcgcagtggacagcgtgagtatccccgccctcctccccagagtgatgtgaacctgccggcccttctggggatgccgagccctgcgtttccagcctgccctttctccagcctcgctccctctccaggcaccgccgttcccttcctctcttctggggtaaagtgggacgcgcccgcctcggcagccacctctgggtcgtgggggctgtcacctacctgtcctgtccctggccttcccctggtaccctgcgctcagtccccccacaccgtcctgtccctggccttcccctggtgccctgcactcagtccccctgcctgtgtctgacccccgtaaggctgtccccgtgctcctgaccctgactggaagcaaccccgccatggcataaacttggcctctgcctcgcccagaccccgcattggctctcctgtgcccaccattgcatttctccccctcctcaaccctgcacaggtggtctgggccaggccccgaggtgttaggggccacccccttacacggggctgtccagctctgtcctctctgacgggcatcagccctggccctgcagccatgtgttcgcccctcaatcatctaggccagggacccatatttagctatgttaagagagacacaaggtcagctgtccctgtccccagcggcttatgcttgggtgctggcaggggttgcaggtgacaccagccctgttgtgaggcagggtcacctcctgcaggagctaccagcgagatgggtcagaggagtggggctgagaagtcgtgtgggcgagacccggcctatgctgaactggaaacgccaggaagggccttgagggggtggatgtcgggcgggggtccaaacatggaggtggcagggagggctgggaagacatttagaggagggcaggccactccctgtggctgtgtgcggggacacgcagggaggccccatccacgcagacggtgcacggttcccggtagacacagttgaacttcatttagcaggcatggggattattacagattttggaacaaagacatcaaagaatgaagctgtggtttataaacattgcctggcctcggtgtcaagtggattgtagggaaacacggggtggagagcattttcctccaggagggtgggcagaggaggtcgggctgcagggctgggagggcggcaccaagcctgggttgggagaggcgactcgggctgaagcctgtgtggccggctggggctcggggagccttccagagacaactggtcaggagccctgtgcggcctaggagcagggctggcccgatgccaagactggggacctcgtctacccagtggtgatggcaggcgagaccctcgaaggaaaatgtggaaggctcagctgcgggagaactctcgaaagctcctcgtgtgacacagtggagaggagagctgtacagagtggtgcaaagggtctgggaagggctcatttatagaacgtgaagattctagaacaaagggtgtgtgctgagaatggagttgggggatatgttgccctctgcagggttgttggggacaaagatttcccagagatgcctttgcctttagctgtccgtgtgcggaggggcacacgtgtgtgatacagagctgggctcggagccaggttggcagggagccccgggaagaagccaagtcagtcttgctctgggggtgccgccacgggtgaggagagcgggacggaggagccggcatcagggcaaggctggctttgctccctgcttggttttgaagcaaaccagccccagcaactcattagaaggcctgtaggagcaggtccacgttccccccggacttcggccagctgctgtgtgcacgtgtgtgcgggggtggtcatgtatgtgggcgcttgtgcgtgcatgtgtgtgtggcgccctgtcaggcggctttcatatgcaaagtctcttaattcctaagtcccctgtgaagttagcttgaatttgcagcctatttactggtgaggcgccgcccacaggagggagcaggggccacatagctgccatgcgaggggccggcaccccactgggcccctgcgccgggtctggagctccttgcccacacagggaaatggaaggtctagcaaagtcacagagcaagtacaggagagtgccaagaacaccttggagaggccatggcttggagccggggaagaccaccctttccttttctgtgtggcaggtgaggggagagtggacggagcttaagcccccggggctcctgcctgctgcccggcgctccccaggccacattctgtcagctcctccgtccagtcactggcactgagacccagcctcatccttagccctgtcagccatgtcgcactggccaccaggacctgctgtgctcgctgaagctgccctgttgggctttgttcagccaaattcactgaccctgttgtccaggcactggcaggcaccccgagccacaggctcgtaccccgcactgtgcgctctcacccgtcagccctgcacaccccacacaaagccactgctgtgtctcccacccacagccgctgctgattcaagtccagcccaggccatcaggtccccaactgtgctgcccacggacccctgggcccctgctcagcccttctgctccctgcacccagccctgaccatagcctccccacaccccaagtcctcacgtactactttggtgtcacagctgaagtcagggggcagtggggaggctgctgccgaagcggacggtgagggcttccaccttggaggcaggcgtcagtcgtacccagcaccagttgacctctcgctggttccgctgattcttgtagattccctgggattttctgctagttcactggttcttgtagattccctaggattttatgtatatgctctctccaagcagaagcagcttccagcccctcttccggttctgggatctctcactctttttctgggcctggggcactgaccatggctctgctggcacgggtcggctaccgtgcttgccatctctcccagctgctcctgatttcctgagctggatgcggggagctgctgctcttcctctcagcacagctgaggttgaccttgacctcagttcaaccttgaaccctcctgggcccagtgctctgcacctggctgtgaccagagaacgctccataatggtgacctgaataccatatatttcagcaaaatattttccctgctacccattaaactacagataaagaatgactgctttgaaagattggctaaagcactggatttaaggttaaaaccctgagtttgatcccatcaccgcatttgctcttacaagtcattttcacttcccttggccatgatttgcctctgtaaaatcatgagccttcggccgtctgccttcagccacagttccagagctcagaaccaggacgtggaaaactgctgtgtaaattatagaggaacaggaacaggaccaggaaggggcaccacgtaaatctcacatctctcctgcctgtccctgttacactaaaaccttttcttgctaaacagaaagcttggctttgtggatcaggacgcgagaggtgtgggtcatttctattttactcttcttcaaattcactgaagagccacattatgtaaacaaagggtgtttggcaggaagtcattttgaaacgtggtttctgtcctacacccatatcttcgtcatctacatggacacacttagaaatatcttggcacctggccacggatgaaggaccatgtgtaggggctctgggatgcacaaaacggtgaccctcacatgacacaaagcccagggtgaagggaggaagagatgccatctgcatgcagaggtctgggattacggccgcctgagcctgctccccagcaccgccagtgctgcaggaacgtgtctaagccaactttgattctcagacttcgtgtttttagtaccttttaggacctggaaattgatgatgtctttatttttagtctcaggggtggctcttggtgaaaggggacagccttcctcgtaccttcctcgtgacattctcactgcatccacagcccatcatggtattgcagtgcagggcgtcttgtttaaaactggctcttggtcccgtggatctcccagggcctgttgctctcgagtgccccaaatggcagaacgtggccatgagcacggaggctgcagcgtgccttcgttttacaccctgctccaggcagataccagggcctcgggtttattattcatgctgctgaaggggtcatctgctcagtactgcttggggagctgttcccacagccagctgggcatgcccttgcctgcagtgttcttgtaactgcctgcaggcatcacaggccttcctgtgaattaatttcttaaccagcttgttgcacctgcatgtttaaaagcaatcattccactgaggggcattttgaagtgtttccggtagaaactgagcctcgtctacctcacctgcctcgcccttccttccatcgttaccctggcgataacttcccagagatgaaagttccctgtgtttttgaggggtcattcctctactcccttcccctccccacgtctggccatggatgttgctggcggtcctccggatctccacccctacccccccatgatgtgtgcaccccctacaatgtgtgcatgcccctctgtgttggtgatggtcctccgaagctccgcccaccatgatgtctgctccgccccctcgtgttgctggtggtcctctggagctccgcccaccatgatgtctgctccgccccctcctcgtgttgctggtggtcctccggggctccgcccaccatgatgtctgctccgccccctcctcgtgttgctggtggtcctccggggctccgcccccacatgatgagtgcctcctgcagccctcagccgtccctgtgactcctggggcttgccattgtgcagatcggggtgcacatggtgtacagacgggtccacctgtgaagatcgcagagcctgctcagaggttcagaggtgcagacagaagccagccactcccccagtgttctcagcatccccctgctgccgccagccggccctcaggacacacttaagagtttgagaaggatcggagcccactcaggctgggcccagcggaagggcgagcctgggacctcccctcatttcccaagcacctttggggcacaccgtgtgtcccattgtgccagaagctctgagggattcatggggaggccttaaagaaggtgggctcgggcggaagaaaagacggaagaacaccatgtgccaccggggagaagtgtgtgccgtttacatgagacagagcagggcacagtggtgacactgatctgacacagatggtaccgcacaggacaaggagcaccaaggggggcacatgaagaaagccgtctgtccaggattctcccaggactctgatcccagagggcctcccccagcatcactccccatgccaggttacactccacttcacactaccagccagaaattaccaggcagatagaatcaggaaaatatgacccgtaatgaagaaaaggaaatcaacccattaaaacctgctcagaactgctgcaggtgttatcattagcaggccaggacattaaaaagttagaagtctactctacatattcaaaaagttaaattgagacacggagaatataaaaagaacccaacttgaatttctagagatgaaaactgcaatatgtgatgggaagaaatatacttgatgggattaacaaccagttaagcattgcaggagaaaacagtacacggttaggcacggggctcacgtctgtaatctcagcacttttggaggctgaggcagacagatcacttgagtaaccaggatttcaataccagcctgagcaacatggtgaaacctcgactccacatgaaaaaatacaaaactcagccatgcatgttggcgcgtgcctgtagtcccagccattcagaaggctgaggcgggagaatcgcttgagcccgggaggtcgaggctgcaaagagccgtgattgtgccatggcactccagcctagggaacagagtgaggccctgcctcaaagaaagaaagaaaatagcaatagaaactaacaaaaatgaagcatggtaagaaaagaaaaaaaaatttaattaaaagaatattattccattgcgggacaacggcaagtgacataacgtactatttgggggtccataaaggaggctagcagaaaaagtatttgaagaaacaatagctaacatttttttgaatttgatgacaattataaacccacagatccacaaagcttagcaaaccccaagcacaagaaaactacacgaaggcatatcgcaatcaaattacttgaaaaacagtgagaaattcaaaagtctaaaggcagccagtaaaaagccagtaaggagcaaaggtgagaatgacggcaggtttcttcttacagatttcctacagatggaaaaggtgagagtgacggcaggtttcttcttacagatttcctacagatggaaaaggtgagaatgatggcaagtttcttctcacagatttcctacagatggaaaaggtgagcgtgatggcaggtttctcacagatttcctacagatggaaaaggcagacagcggaacagcatctttaaagcagagagagagacagagaaagagaaaaaactgtcaacctagaattctatacccactgaaaatatatttccaaatggaggcaaaataaagacttttaaagacatacaaaagatgaaagcttatccccggcagatccacactacaagaaacgtgaagtcctttagccttgaggagaatactcttcagagggaaacacggttctacacaaaggaattcaaagcagcagaaatgagtactatgtggataaatatgggatttttttctttttatttaaatcttctttaaaagataattgttttaagaaaaataataacagtgtactatgaatttttttcaataagccttttgcactcttaattttttttccttacgagacaaggtctcattctgttgcccaggcctgatcaccgctcactgtaagctcacactccctggctcaagccatcctcctgcctcagcctcccgagtagccgggatcacgggcacaagccacggcaccccacagaatgtataacatttgtaagagcaaaatgcatgctaacagtaacaaaaagatggggaggagagagaatgaagaaatactattgtaagattcttggactttgtttgaagtggtctcatatcacctgcctgaagatgaactgcagtagtccataaaccctaaagctgccactcaaattttaaaaagaattacagttaattagctgacaacagagatgatatgaagtcataaatatagacaacacggaaggaaaaagataaccaagagtagatgtaacaaatagaaaaaggcaggatgatagatggacacctaatcctgcccgtcactgcagtgtggagactgaacgccacaatgagaaggcagaggccaccaggttgaagagcaagaaaaaaccataccatggctacaagcaatgtacttttggcataaagacacgagtagattgaaggcaaaaggacgggaagagctctgccatgcaggcactaagcagaggaaggctgcagggcctatgttaatatcagacagaggaggtttgggagcagagaacgttgctaacaataaagatagacatttcataatgctacggaagtccattcatcattcatcaagagaacgtcgcagtcctaaatgtctattcacctaataatagagtttcaaaatacatccaacaaaactgatggaactgcgaggagaagtagataaatccgtaattacatttggaggtttcagtgctcctttctcagtaactgacggaacaagcagaagagaaatcagtaggaatagtggggacttgagcagcactctccagcagctgggccctgacgtttatagaacacgccacacagcagccatgcagtgcacagaggctgtgccacgataggcccgacccttggccaaataaacctcaacaaatgtaaagaactgaagccttacaggcgtgttctacagccacagtggagtcaaactcaaatcaataatagatagtaggaatgtctctaagcacttagaaacagaaacttttagataaataaatgattttcatttcattccataaaattttaagtaaattaatatatatgtgcttaatgcaaaatagaatataaatatgtaatattaagatacatagatattataagtcgtgaataacaaagatttatataaaatatttattactataagtatgtatatataatatataatataatgtacatataattataaatacttgcattaaataaatacattatataaacatgtatattaagatataaaataaataggttgagtatacgtggacccagctctgaacagtgctgagaggggagtgtgtagcagctgctagacaatgcattggaaaagagggacggtctccaaccggagatcccggcttccacctgaagagggcagcgtgagtggagtaaacccaaagctgtcggccaaaggaaatgatacaaatcagactggagactaatacgaaagaagacagtgaaacatcaaaatctgttgaacaaaacatttttttaaaaaacacatgaataaaactgtgaaacaccaccctgactgataaggaaacaaagaagacacaaattccagcatcaggaatgatagaggtgacatcatgaaagattctagggatattaaaaggatgataggcaaatatcatgagcaacttgatgggagaacatttgataactttgattccttgaatgacacataccactcactgaggaagacatcattaatctgaatagcactatgcttcttttttttttagagactgggtctcaccacattgcccaggctagttttgaacttctgggctccagcgatgcttccaccttggcctcccaaagtgctgggattaaagcctgagtcactgtgcctgtcactacaagtggaatttgtagtgaaaacttttactacaaagaaaactgcaggtccagatgacttcgccagtgaattttactgaacattaaggaagacgtatttggatgacatctaagcaccttcccatattgttctatgaggccagcattacctgataccaaaggttagacacacgttacaagaaaagaaaactacagataagtattctcttgaacacaggtacaaaaatgctaaatagaatttttgcaaattaaattcaatgctatttaaaaacaaaacatgatctagtgggatttatttcagggatgcaaacctgtttaaggattgaaaaatcaatggatgcctcttcagattattaaagaattatttttaaagagagaaaagtccatgtaatttaccatattaaaaaaagatgaaaaccatattaccatctcaagagatgcaggcaaagtattttaacaaaatctgagatccacttctgatttaaaaaaaaaaaactccctgcagactcctaatagaagggaacttcgtctacctgacaaacagcatctccacaaacttacagccaacaccatacagtggtgaaagactgaatgcaagatgaagccatctgttcttgtcacatcccttgacattgtactggaagttctaggtagtacagtgagtcaaggaaaaaaaggcattcaagttcaaaaggaagaggtttaactgtattttcagacagcatgattgtctatgtggagaatccagtttaatctattttaaagtgctactagaaaaaatttagtaagtttgcaggttataagatcaatatacaaaaatcaatttatgtatatacactagcaatcaacaattcgaagttgaaattaaaatagagaacatttacaataccactaaaaaaaaagaaatacttagggatacattctgacaaaaggtgggcaagatctgtacaccaaaactacaaaccattgtgaaaagaaatgaaggaagacctaaataaatgaagagatcgtccgttatcttgatttctgcttctgagatccacatggaaatacaaaggacctacagcaggcaaaacaactttgaaaaagaaaaacacagttgaaggactaatactacctgattacaagagtgactgtaaatccacagtactcaagatcggaaatagcttcaaatggacaaacagataatggaacaggaagaaagtcagggaatagacccatacatataaacacctgccctatgatgacatggagaaaatgaaaaggcaagacacagactgggaaaatattgacaaatcgtttttctgttaaaaacttgtggcaagagtatagaaagaactctcaaaaatcaatatgaaaacaaacacaagcagacaaagaaaattgggcaaaaggtttgagcagacacttcaccaaagaagtacaaatggcaaatcagcacatgaaacaatgctgaatatcattagtcaccagagaaatgcaaactgcacccacagtcttataccactgcacaccaagtagatgccagaaatgcaaactgcacccacagtcatataccactgcacaccaagtagatgcctaagaagctgctgttatcaagtgtcggcaaggccgtggaggaactggaaccctcgtatgctgctgagggcagtgcaaagtgtgcactaccactttgcaaacttatttcacagtttcttataaagattagcacacactcagcatacaatccagccattcctttcctaggtattccccaagagaaatggaagcatgtccacacaaaggcttgtacatgaatgttcctagcagctttatttataatggccaaaaactgggaatagcctaaatatacattaacaagcggatgaataagcaaactgcaatctttccatgcgatgaaatcgtactcaacaatgaaaaggcatgaactgatctcaaaatagttagattgagtgaaagaagccagtttaaagaagggtacctgctgtatggtgccattcatttaaaactctagaaaatgcaaactacagtcacagaaagaagatgagctgctgctgggggcaggtgagggtgggggcacaggggcagaagaaaatgtctgaggggccagaccccacctagactgtggcggtagcttcacaggtgtagacgtacgtccaaaatcttcaaattccgtacttcaaatttatatgtcgcttatacatcaatgaagcggctaaaaaacttctcattgtgggacagtctacaaagaactgtactgttcccttctagattttattttgtttttttattttttctgagatagagcctcactctgtcgcccaggctggagcgcagtggggcgatcttggttcactgcaacctccgcctcccgggttcaagcgattctcctgcctccgcctcccgagtagctaggactacagacgcctgccaccatgcctggctaatttttatgttttcagtggacgaggtttcccatgttggccaggctggtctcaatctcccgacctcaagtgatctgcgtgcctcagcctctaaagtgctgggattacaggcgtgagccactacacctggccccccttctagatttttaattcaagaaacacccccaaaaatgtggggggatttattctcaagactaatgtgtatcagctaagtgcagttcctagttggatcctggatcaaaaatcagaggctcacagaggacagttgtgaacaattgggaggaatttgactctggactgcgtgtcaggcagcaggattgggaggagtttgactccagactgcgtgtcaggagggaggactgtgtcgctgtcacgtgtctggagtgtgatcatggctttgtgctcatggaagcaaatgtccttttccttaggaatatttctgggcaaagcgtcatgctatctgcaactttcacacagtgcagaaaaacacaggggatcagggggcagaaagcaaacatggcagagtattttttgaaattgtccttagggtcatgtgatgggaccagagctcaagagcagcagaacttcatgatgagaaagtccaggagatgtggccacagctgtcttccgctggtcacactttgcaaggatggtggtagtggttgttttaataagttcctcaagcctgctgttagcatttgtgtatctgctaattagcaagattaaggagggggagagttaattaaggactcccgtaggcaaggttccagttaattgagggtttttcatagataaaattaatactcagtccagactgaccttctgagttatagttaataaagttgtggttatggtaccaccagggaactccaagagcgtaatgtcagtggatctggaaagatgctctgtgatggtattcatgaagtaaatccagatttggaaattcaaagaggcttcccactgggaacaggctgctgtggtccccggaaggaacccgcactatgaagaaaaggcagatgagagagtcatagaattttgtttctgcagcccccacgtctgtgctggttctcctacccgtgctcaaattctctactgttttctctgcaaagtcgtttcaccacagttcgtgtatgctggcgttgatagcctctcctcttcctgcttctccacttttccccactcccccttcctcacacacgtacacgcaaaactcaattcaaaaaatgtgcaaggttagctttctctgtcatccagcgatgactcagtctcaccaagggggcaagagagtgccatctagagcgtgtgaccctgctggtcccacagcagaaggcagtgccctggtgggggctagtctagttaggacctgagcaaacattttacttgtgtcccgaactcttgttcctatagtttctatcttaacaaattttatttttttagaacagttttagatttacagaaaactggaaaaggtagtaaatagagttctcatgtaccctacacccaattttccctgttgacatcttctattagtacaacatgtttgacacaacagtcaatgaacttatgttgatcagttattaactgcagttgatactctcatcagattttcttgctaatgtcctttttctgtcccaggatcccacatgacattgagtcctcgtgtcttcttgggcttctcttggccgtgacagtttcccagactctccttgtttttgatgaccttgacagctttcaggggtactggtcagggattttgtagactggccctctgttttgatttgcccaatttttttttcgtttgagacggagtctcactctgtcacccagtctggagtgcagtggcgcgatctcggctcactgcaacctctgcctcctgtgttcacgccattctcctgcctcagcctcccgagtagctgggattataggcgcccgccaccacgcccggctaatttttttgtattttgtttagtagagacgcagtttcaccatgttagtcaggatggtctcgatctcctgactgcgtgagccaccgctcccggccatgcccaatgtttttgtcctgattagattgggatttggagaggaagaccacagaggggagtgcccttctggtcccgtcataatgagggtgcatgctgttggaatggcagatccctggtggcgctggcctgggtccctggctgaggtggagcagacccggctgaggtcaggcgtcccccgggtgaagccgctgctgccgccccttccggaatgggctgctctttggaaggaagtcgcttggatgtgctaggcttttgttgcctaaactgctttatgtctgtggttaacttattccttcctgcagtttcattatctttttagggtctaaatatagttcttttaatttcctcttgttatttatataggcttactgtataaggcttagtcttggagttgttttattttattacattttgttttgcatttctgggattttttagtattccttctttcagtttgccccttcttgagctaaccttcctgcagtaccatcttccagctgactgtcagtggatgaggtggaaacagttttaccctttctgcagggagctttgccagttagggacccttcaggagtagtcaggaacgcgcctgtgcccacagttgggtgagtcccaggaacggcaaaaatgtcacctagcgttccccctgctcatctaacatagtttaattgccttgatggtccatggaatttccaaactagaggttgtgatatgcagaaaatcaacaagattgcattgctagggagcacgtttgtgaagctggcgtcttccacagaagctgtcatcagcgaggaggggctgttgaggggacacatttgtgaagccagcatctttcacagaagctgtcatcagcgaggaggtgccgttgaggggactccgggtgatgctttcgtcgtttggaaagtagcactgctgtgcagaatggcctctttttagccatcctcctagttccatgtggagccctcagaatgggttttactccgggcagattccaacacaccctcatgctatcccgggagaactgcggaccaggaaggcagaggccccttcctcccacccccatggaagccagaccacacgagctgggccacccagctgtcccagcactgggtcggtcctgggagaccacccaccccagaagagaccaggctaggtgacatgcacattggtgacaggccaggctgcagggaactgggtctgtcggtgccccctgggaaggtgggaggtgtttggctggagggagacagttgtatcagctgcctccgggttgccaagaatgaaatgaacaaaagagagaggaacccggagggggctgtctgcccagccatcccagttccaggctcttttcgcctgcacccaggcagactagaccgagccctggcaggggtgacggctcgccctttgcaagatggatgggcacaacggggccctggcaggtggaggtagcacggcaggctgtgccgagggcgaccacagaggctgtctctgtgtggcaacttcagggccccatgattgatggttaggctgcttggaacctgatcaaatctcagctcagcctgctgggtgtgagcaagggagaggggatggggagcctggtcagcctagagcgggccccccaccactgaggaggccccgggggggacccccagcctgacttctccctgctcatggctggctcctgtcccacactctttcgctactgtatttcctcttcttagtattagaatttggatgagaaaggcaccacagttttgacctgaggtcaaggctgggttcgttgcaggtccagaaggctgcagctcagacacctactctagccagaaatgcccggggctctgtgcggttccaagggctcctttgccagccctgccactgggcacagggagcccctccactactcaccgcagacagagcagctctccagtgggaagcaggtcctgggagtgattggcatacgtgatctggaattgtgatgtttctccacagcccaaacatgggttcttttattcattcatccaacatttactgagcgcctaataggaaccaggacgtgctgcctcctgggactaataaagactaataatgcatgtttttgtcctcacagagctgaaatctagcccggaaggtggagggtggaaatggctaactcaaatgcagcagcttgggaagtgcagtccaagtccctgcaaagggtggggagagaagcctttgcagaggctgttgcccggggacagggccccaggcggagaggacaaaggcccagcaggcagagggagctcaccacattcccaaagccgcaaaacaatgagctcggtgtgccccaaagtctgaggagctgaggagaaaggggaagatgagtttctttgtgcagagatgtttctcagtcaccactgtcacactgctgggttattgacaccagaatgtgaagaatctcactgtcagtgccacatgtgggagggcattgcttaccatgactcagcgtggcctcagggacagtgcgtcaggcccggcaggacagcactcggtctgtgctggggaagtcgtgcagacgtgcagagatacagacatgtggacccaagtcagccccggactgagcagcgggtaccccagaagggatgggcagtggaataaggattacatgtaggggcagaggacgtctcagtctgtacctgtctatagcattttaatgtttgagccttgatacctacaaattttaggacaggtttgaaaaagattgaaaaagatggaaagcatgccagtgattttgctatggacatcagatgcagcattcagggccactgtagacgtgggtatgtctggcctgagaataactaaagggctttttttttttttagacagtcttgctctgtcaccaggctggagtgcagtgacatgatctcagctcactgcaacctccacctcccgggttcaagcgattttcctgcctcagcctcccaagtaactgggaccacaggcgcgtgccaccacgcccagctaatttttgtgtttctagtagagatggggtttcaccgtgttagccaggatggtctccgtctcttaacctcatgatccacccgcctcggcctcccaaagtgctgggattagaattaaccatttacagaaaatcaatgtgtctatattaatatatatatttatgttgaaatatcttgcctcacttggcgagtggggaatacactgtgcctgggggtgaaggtctgaggcggaaagcttgtcttgcactgctcggtggatgttctgctgaagtcgtgaagagcagtgagctcttgtgaccggtaaacagaaatccctgcttcggtatcatttccccaggcattagcagttttattggcacccaccattgtgaaaacgctgcacatatcaacatctcagcacagccctccatctgcctgcagatgacttccccggtagcatcctcacgttacggtaacacaccaccgaaggctcactcaggagctgtgttcttgttggaaacttttttccttcccagcaccccgctcataacaagggctaaactcttctacccagtggacatgaaacacggcccgtatctctgtgattgtctctgtgttcacgtcagaacgcacgtggtagggtatttgcgtgaaatcgcgcgtggtagggtgttcgcgtgaaatggctcagggcttggctcatcatcctgcctccttatgccttccccgtcaggcacggtggtctgttagcctgggcgtaattcttgtgttcctgcttctccataaaataatccttaaaatctttgttaaggagaataaagggagggtctcttcccatggcatcttttgccagaatattcagaggaagaaagcccgccccggccttacgggtgcaccttgtagaaggcagggccttggccaggggctcctcctggtctctgccccattgtcgtgtctgcttgcaaaccacatctttagttgctgcaacaacaaatacatgcttgcatcttcccactttgtgtttgctcttcttctcttcttcacctcccttttccccatttaaaaaaatataagttcctgaaacctgagacacagaagaatcaaaattggcttcagtgtgtggtgagggaagggggcttgctcaggaaaaaaaatgtcatgttcatgctcttcccacctgctttctactctggccttcacatgtcaccaccatagcttgatctgggagaaaacaagcacagcaagatggagcctgttgagagggcggctttggcagattcacgctgccggcaccgtgctgttcatctgagccccgagtctctgccgggtcttccaccaagcccctccgcccaggatgtgtgtgtcgcctgccgggtcttccaccgagcccgtgccacgcagggtgtgtgtgtcgcctgccgggtcttcacaccgagcctgtgccacgcagggtgtgtgtgtcgcctgccgggtcttcccaccgagcccgtgccgcccaggatgtgtgtgtcacctgctgggtcttcacaccgagcccgtgccacgcagggtgtgtgtgtcacctgccaggtcttccaccgagcccgtgccgcccaggatgtgtgtgtcacctgctgggtcttcacaccgagcccatgccacgcagggtgtgtgtgtcacctgccaggtcttccaccgagcccgtgccgcccaggatgtgtgtgtcacctgctgggtcttcacaccgagcccgtgccacgcagggtgtgtgtgtcacctgccgggtcttccaccgagcccgtgctgcccaggatgtgtgtgtcacctgccgggtcttccaccgagcccgtgccacgcagggtgtgtgtgtcgcctgccgtgtcttcccaccgaacccgtgccacgcagggtgtgtgtgtcgcctgccgggtcttccaccgagcccgtgccacgcagggtgtgtgtgtcgcctgccgggtcttcacaccgagcccgtgccacgcagggtgtgtgtgtcgcctgccgggtcttccaccgagcccgtgccacgcagggtgtgtgtgtcgcctgccgtgtcttcccaccgagcccgtgccacgcagggtgtgtgtgtcgcctgccgtgtcttcccaccgagcccgtgccacgcagggtgtgtgtgtcgcctgccgtgtcttcccaccgagcccgtgccacgcagggtgtgtgtgtcgcctgccgtgtcttcccaccgagcctgtgccacgcagggtgtgtgtgtcgcctgccgggtcttccaccaagcccctccgcccaggatgtgtgtgtcgcctgctgggtcttcacaccgagcccgtgccacgcagggtgtgtgtgtcgcctgccgggtcttccaccaagcccctccacccaggatgtgtgtgtcgcctgccgggtcttccaccgagcccgtgccacgcagggtgtgtgtgtcgcctgccgggtcttccaccgagcccgtgccacacagggtgtgtgtgtcgcctgccgggtcttccaccgagcccgtgccacacagggtgtgtgtgtcgcctgctgggttttccaccgagcctgtgccatgcagggtgtgtgtgtcgcctgccgggtcttcccaccgagcccgtgccactcagggtgtgtgtgtcgcctgccgggtcttccaccgagcccgtgccatgcagggtgtgtgtgtcgcctgctgggtcttcccaccgagcccgtgccgcccaggatgtgtgtgtgtcgcctgctgggtcttcccactgagcccgtgccacgcagggagtgtgtgttgcctgctggctgccgttctgcgcgtgtgtggtttcaagtcttgtttcctcttctgtttaacgaggcccttggtctaagtgtgcttgtaatttgggcgagtgagcagcagccgagagagtccaccccagtccccctagccagcgaagtgggagctcccaggttcctgcctgcggggagggtgggggcggtttgagttagtgaaaatgtgtgtattaaacagatatgtaaatgacccctgccgagcgctgaaaatgaaggtatgaaaaggcatcatcatccgtggttcccacctggcataatgaccgtatcagaacagacatctggtagtatacaccacatagttgccagactccgataccaagggcacatctaagttctcccaccctgatttgcatgcctcaaattcagaattagtgagatttgagtcagtgatgcttcattacactctcgtgagacatgtttgaggagcttcaccgtgaatgtgtgggcttcgatttgacttgtggaacctgtggttaaaacaaaggaaggtgccttcattctcagaacccagtgctttttctgttgccctggccctctgggctgagtctttacgtggacggcggtcgatgcatctcagtttatttgtcaaaaccttcagctaaagccagttgttgcttgaaaactgcctgcttaattggcctcctcagctcgggggagcagcttgcaatctgaggccggcgcctggctccctgaccacccgctccccatcgtgctcagctctcattccagcagcccagcccataacccgcctcatcagtgtattgatgtgaggcagaaacacctcattgtaagagcacccctgagaaatggcggggttaggggcttctgggctgcataaccagcagattccctctgcaaaactgctcctgcctcagtgggaaagggccagctgtgcagggctgcactggagagccgttctcttcttgatcctcaggcatccagttcttaaaattccggccctctgtccttgcatggccttcgtcctctggaaaggagcatgctgggagctggcagaacgcacgcctcactctgtcgatgcagtgtctgtcactgctcagtttctaggtattgatcctagaaacccatgctctgtgggtccctctccaagaaacacagcatccatgatttgtacatcgcactgcagtttcagactgctttcacatgcgtggtttcatctctgactccacgacctgagcacagattttttttttttgagacgtagtcttgctctgtcgcccaggctggaatgcagtggtgcgatctcagctcactacagcctccgcctcccaggttccagcgattctcctgcctcagcctcccgagtagctgggactacaggcacgcaccaccacaccctgctaatttttgtattttttagtagagacaggatttcaccatattggccaggctggtctcgaactcctgaccttgtgacccgcctgtctcagcctcccaaagtgctgggattataggcatgagccaccacgcccagctgagcacagatttttaaaactttacctgggtccctgactagtaagagggagaacctggacttgaaacttagttttgtttcaaatcttgccccttttcctcgggttttgggcaaatacttcccgaagtattatcgttacccctgaatatccaaggcaggatcattttattcccttccagagccagcacttgcagaagtgtccccaagttaggcagcctggtgtggcttccggtaacactgccagcctcagagccggcctgtttcctccaggacgcccacaggaccctcggaagccccttcctctaggggcccgtccctcctccttccccaggccccgtcccccgccttgccctctgaaagtggtcttcagcaccacccgataagcggtgacttctcatcttagaagcctggcttgggtcaggttctgcgtttcggctgtgcgcgccccggagcagccctgcttgtgtctcatcatcgatgcctcagctgcagtgtgccccactgtaacccctccgggatgaaaacgcaacccacctcttcagtgggcagccctccacttggatcctcgcatccctggcatcatctccgtcctctgtccttgctgacccagctccaacccagcctgtctgacccgtagcccacctgccatgtccttcccggctgcagctcctgctgggctctgcagcccctcctgcccaacgccacctgcccccgcctgccctgctcctgcttgcccttcccctgcccctgcccccgcctgccctgcccccacctgccctgcccctttctcctcccactcccacatcccgggcctggacctgccatttcctagcagcaggagtcttttccctcgatcccacccttccccttcttccctcactgccctggacagttctgtctgctcatcagcgtaaagaggtctccaaaaagtacaagaccctccctctccccgctttccaagcaccctatggtgcctctcgctgctccttcaggaactgtgagcagggcacaaatacctagtgctcagcacccagtaggccctcacgactgtgccgagccatggccgtgtggctgtgattgtgctgacagcacacagtaggtcctcacgactgaggcgagtcatggccacgtgactgtgaatgtgtagacaggcacagaatggcctgaagcgtgggaaggtcgcctgcctggcagcagctttagcaccaggaaacctcccaccttggggctgcccctgagggtgaacaagtggggccagtgggaagcacctgctcaagtgggactgtgcacacaaatcactgggaattactgcctcacacacgattggttttcagcattttgtaagtccaagcaaacccccaagaaaagcttgagcgggaccgggtctgcaccaacaggctggttctgagtgagtgctggatggatgtgctccagtgtggagggcagagggagggagcgggacccctggagaggagcggggtgcaggcaggggctgcagggcactccccagcaggtgcccggacgttgtgaaagaaaacgtctgggagctgctttcctctgggcgttcgtgggatccctccccttcttagccaaggaaagcatgtctgcaggcaccggctgcagctgtttttcaaatgaaaactgggcttgaaaggaggaaataattgaggtataagaagtccctgcccttattcgttcacgcaccatgagaagcttgtggcatctgcgggacactgcactcactgcctctcctctgtctctttctgtccagtcgtgccaagcggacctcgtgaaggacaacggccacaagtacttcctgtcggtcctggcggacccctacatgccagtaaggacggggcagcacgctctccacgggcttgggactcagcactcgcctctgcccacacgctgcactgcggtggggccttttgacgggggctacaggagaaaggtcaagggtcacagcaggggccacgtccacggggtcagcaactgcttcacgttagacatggccctttgcttactaccatgagcgcagctgttatttcgtgtctgtctctaaacaagagctcagttaacccggacacatgggtggttttagtttattttagtctcttttcactgggacttctttgcaaaatagtcaaatccactctccctgctgtccgccgcgttagactagtgagcgccgcacgtctgtaatatgagagttcaggcgcctgggaaggtcttggagcacaagaagatatcgaagcaccccatttcaggaaggaagggagagaggaaaggaaggaaagaaggttgtttgaaagtttaaattttcagtatactttattgtattaaattgtttgaaaattagtaatccatgaatagggtgtatagttattctataaatgtttcataatgttttaatttctaactcccagcttagtaatgagaacaaaatagatatatcctaaataattctttaacataacttaatattgccagaatatttaaacatattagctagtttacacagtgttcggtggctttgctgtataaaggaacttttgtatgtaatttcaccccctagttggttttctaagctaaaggattttttaaaacacaaaacaaacaggactattttccaaaaggtaaacagtatgtgcactttgtgttgtattgaaacatcacaggcagttaaagttgatactttgtatcagttttggaaaccatcacttcccattcttaagaataaggaagaaagcaaatcccacatgaagaagtgaggaagaatgctcactggcgacttgggcgcgagggtgagctaagctcacatgaacggccccacctcagccacgagcctgcggaagttttgaggacacagccaggtttgaaagaatgaaaaggaggctgggtatggtggctcacacctgtaatcccagcgctttgggaggccaaggctgacagactgcttgagctcgggagttcgagaccagcctgggcgacatggtgaaaccccgtttctaccaaaaatacaaaaaaatttgtctggcgttgtggcacacgcctgtggtctcagctactcaggaggctgcagtgggaggatcgcctgagcccggggaagtcaaggctgcaatgagctgtgactgtacaactgcactccagcctgagcaacagagtgagaccccgtctccactcaataaataaataatataaatattcttaaatgactgactagaaagaatttgctatgattctgtcaaaccatcaaccattgttttgtttcttcagtgctttgtgcctgttatgagaaaacattcagtgcttcctactcatcctcagaaacgattgatttttctaaactcataagcagatctgaaaaaacaaattgaagctgtgaaaaagaaaagacatgcactgttattgaaaactctggagatgaattaaatcacagaacagacagccaagaagagaattcatgaaggagccacctggagcgccgtccatgaagctaagcgagaagatatgaaagccgggctaagagccgggctgggaacgttcaccatgtagccagcatggttcagaatgagaggagaataagtagagaagcagtttttgattagatagtggctgagaattttccagatttgaagaaaggagagttccgattttaaaagcaggatgaatcctgagaaggttaaagagaaacaaattcgtacatagacgcatcataatgaaaacagcaaatatcgaaggcataaagacaaaccttaaaagtccccagaacaaacgttattagcaaaggaggagacagcaccggccccaacagcagacctctcatcagcagcggctctcggccggggacaggggagccctcggcgtgcgaggaaagcgaccacggtcgggtcacctgcacccagctcagtcaccactcaggaatgggggtgtagtaagcagcgttcagacaccaacagtttactccttccgaaccccacagaccatggctagaaagaccacatgtcagcgaggaggaaacggaaccaggaggggaaagcaagatgcaggacacggcaaaaagccaagaagttggcacacgtgttggcacatctatagatttgtaaaaatgaagaatactcatggcgaattggagggttaaacaagaggaggactcaggtaccctgggagccctgcaataatccaaggagccctgcaataatccaagaggcgcgtaggacactagaccgcgcgacgtgtgtgtaaaaaactaaggcaccgctaaaaagttacaaatagactctggtttccaggtcagcggaggcacagaggaaaggacagaatgaaaatgagtcacagtagagcagaaaggagaaaccagtgaaacctagagcgctgcctccatgccttttgctgccaaagcccctgattgcaggaccgtgtgctcacagagtgctgggcaggctggggaggtgaggtccgggtgcttcataccgacagccacggctggcctgtgacagaggaggcatccaccaggtctgtgcccgtcttgcagtgttagggcttccaaggagcagtctgttcactccgggaggcgagcctggagctctaaggcctttgaaaacagctgttcttttttgtagagtccacgtaaaatccaggagtaaagctggctctcgttactttaattatgcgccacgcgtgtcatgaagattccgaaaggatcacgctgttgtactttgggaatgagagtttccactgaggggagacgaccaggactggtttttgttttccaggctgaacaccggaccatgacggctttcattctcgccgtgatcgtcaacagctatcacacggggcaggtgagccccccagccacccccagccccagagctcacccttggcattgcagaggagctgggcccactgtgaaacgtggtgccacatgggggacagggggtgtccagcagaggctctgacccttcatctagccagccatttgcaggctgaatatgaatcagaggaatctaaaatggggaaaattgagcaaatcaaggcttcccaagaatgggtggccaccgttgtcccgtgcaggtacccaccacgtgcctgccattggcaggcagaggccaacctgtctgtggtcccgcctctgcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtgagtcaggcgggggctcagagtccagtcctcctggctgccgactgcgggggtaaggcagaggtctgctcgcgtgcgggtgtggccggccacgtgtccaggaacttcaggggctgcacgctaataagagtaggacagtgggaccttggtgagaagagaaccacaccactggggattttgcacccaggcccagagtgcgctcccggggacagtggcacagctgcaagcgggggtcccagagggaacctcagaggcaggggtcacgtgctcgctgtccgggtgccgctctgcgtcctcactgtggcctgcaaggcagggaccactagatctccactttacgggcaaggagtcaggccagtggctcgtgcctggtgcagctgggaaaggtgcggggcactgcccacagagtggccgcgggctggaactctgggagtttcatgcaccattgccttcactcttcccaccggcctgtgcagtgcacagggtgttgctcatttttagagctgaggaagcagactcagggacagtgacttctccccaggaccacatggtgtcagaggcaagggctaagccagggtccccggaccccagggccagcacagtgtcgctcccctggctgagccctgtgtgctcagtgcacttcagggcccccatgcccctctgcgtccaggagtgcctgcgccctcccctctttccaccctcccacgctctgtggcccatcccagccccctcgtctaactcctgcctcgttcatcagcacattccctggtgcctggtttggtgtttcagttcccggggcaatgcagctcccgcctctgcagtctgagctgcccctggagctgggcggctgcccctgctgctccccacctccttccccgttgccactctgatagtgcgaggagagccttgggcctggagagctgttgagcaagcgcctgtggggttggattcacctgcacacacagccctggcagaaaggcaggctgcagcatggcccggtgtgggacatgcctgtgaccccccgccgccttgcaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggtgcgtgaacccccagcccggcagcagcagggcacccaggctggaccccgtgacacctggggccaagcccgcatggccctgaccacagcagggagcactcagtttccactgcgtgtcattgcgagagcagatctttacatgtttcattctcttcaagttgcgtttctttaccagacacccatgggtttgcttcatttaaaggcatctagcaggctgcgcctcccggcagcttgtgtagtagtctccttcctgcctgggagcaacacacacaggcaccactgcgattccaaagagacgcagccacccacagatggcgggaaggtttgtgtgctgggtcccccccaacaccccatgtacgtcagcgactgaacaaaacagttttatgttttgttttgttttgtttttgtttttttgagatggagtctctctctgttgcccaggctggagtgcagtggcgtgatcttggctcactgcaagctccgcctcccgggttcatgccatctcctcctcagcctcccgagtaactgggactacaggtgcccgccaccacactcggctaattttttgtatttttagtagagatggggtttcactgtgttagccaggatggtctcgatctcctgacatcgtgatccacccacctcagtctcccaaagtgctgagattacaggcgtgagccaccgcgcccggccaaaacagttttataaacttgaaaacttacttacctgtttagatgtagaaatatcacagatgatcgtccaaggtttcacaccctcagattccccacccaccccagcgcaaaaggggcgtttaggaagacactggtttcctgatctcctttgctggtgagatggaaggctgctcttgcagagaactcatctgacagctggagcacagagctgctctatgggcagggagtgtgtctccccgtcaggtggcgttggccaccctcgtgcgttcccgtgctggctgtgtgtggctccctcttggagatgggctttatcatgagacgggccgtggtccaggggcctgggggttgtttgtctggagagcagctgccgctgctttacttgggagggacgtgacccggacaggtttccctcagccagacgaagtgtggaaagtcacgttctatcgtgtgtacccttctagaattagcccaagtcatgagtatgctacattttctaacgaaatcttgaaaataggaagtgaggttccgggctgccttttctgttggttctgactttgttgccatcacgttctcctcgtggccgggtttctgaacctggcttcttttggcccctgctgaattctttttcccacatcaactcacgtttggtggacatcactgatcaaagcagcaaatcagcggtttgtctgctaaaattctttttaaagtaaggaaagctttgtttcttctttacaaaaacgatatgaaaatagagaggacgttagctgtgaggcgttccccaagagccatcccgtggccgggctgtggccctgtggtgtggccctggctgctgaggcactgagacgaagctccccctccaccgggagcggtccggcgtcactcgcctgcacggctgcctgctgaacctgcatcctggagatgtggcccgcgaggacaccgtggggttcggaggaggtgctgccaaccgggacgcagctgtctcggggatgctgggcagggcgtgtagagggggatgacagcccctgccctccgggagcacgtggtctaatcaaagaggcagatacagataaggtcattacaccagagccttgtggagaaatactgcctggagtgctgtggagctcctgagggctgtgcctgtgcctgcatcggagcgggaagggtgtcagcagaggcttttgtggaggggcagctcttacctggttatggagggtgagcaggagaagcagccaacagagctgataacgccagctggcagggtgatgtctggagggaggaaggctagcgaggagtcagagaaagacaccgtcactcacctgtgaccaagcgggctgcactggcgcgcagactccggaggtgcgctggctctgaggggctgtgctgactctggggggtgccagctcggggggtgcgctggctctgagggggtgtgctgactctgaggggtgccacctcggggggtgcgctggctctgagggggtgtgctgactctggggggtgccagctcggggggtgtaccgactccgggggtgtgctgactcttggggggggtgctgactccaggggtgcgcctccatcctcgtcatagagtcctgccgcatcacagctggttttctcttctgtttactaaccaccatgggcaggcacggtgctctgcaggggacttgggcacaggtgcaagcaccaaggagcctggcggcgtggagccggccccattctcgcagcctcttctcaaggaccatcctgagcccgtcctgagcctgctgtggggctggggttggggagtagaactggctgagaggctcctggcaccctctggggtgggagagaggagggtgttactgctgcttttccataaaagcaacgtgtactggttaccaaaaaggttacatccatcctactttttaataataaaagtgtcctctcctgtgtggggtgataacgatggccgagtaggttttgtttgttgacttgtttaatgagcttacttgacaaaatttaaaagtcagcaaattcagcttagcccccaaattattttgaacttcaacctgtctttgaagtacaaaacctgcagtcagcagccacccgtcccttgtcaagaagggccaggccaggggtgcggggctagaacccccagtgtcaccccagcctctgcctgggccgggctgggcaggagccgcacacagggacgggctcagcggggcttggatgggggcttactccctccctgtcatggcctcgggaggaaataaggactgttcagatactattttattttatttgttttattttattttgaaacagagtctctgtcacccagattggaatacagtggcacaatctcggctcactgcaacctctgcctcccgggctcaagcgatcctcccacctcagcctcctgagtagctgggaccacaggcgcgtgccaccatgctgggctaatttttgtattttttgtagagatggggtctcgctgtgttgccccaggctggcctcaaattcctgggctcaagtgatccactctgtaatcccaggccttggtctcccaagatgcttcccaggacgctgctcgggcctgctgtggtcacaggagctgagttttatgatgcctgagcacaggtcacaagacaaatattagccagtgctgtgttgttggagcggagtgggtggccctcagggcaggtgggcaaggggtagaggcgaggtgggccagtagcccatggtcagtgcagccgtgtcaacactgggaagtgtgtgggcccccagcggggcaggacatgtgtccaagaaagatgtccttgagtcctggcaccagttcacggttagaaactaaccatgtgctacagacgacacccctgcagggagggctgcacccacccagaacacacttgtcaggcacgtgccacgtgccgggccggctggggcctcagtgaccccgcagggcactaaccctgcctcttctctcaagaaagttacccctggagctgggggaggggctgggtgtgagagtggtgggccggggtggcagctgagcagagccagtatggatggggctgggggcacagggaggccttgccacagggagaggcccagtgcaggggctgtgcccatcagagggcgtgggcacaagaggccaggagggcagtggggcaggtggcccagccaggcacaagccttgtcgttcgtgatcagaggcctggaggggtttgggggcaggacctcaccttcggctgcccaggtgagaggggccgctcgcccagctgcagggacggcgcaggagggaagaggcaccagcactttgaatgcggagctcacagcacttgctcacaggtggagagggtacgagaaaagaagaggacagggaatcctgggggtttgggtctgagcaacagaagagcagagttgcccctcgttgaaggggccagccatgaaggagcaggttccaggatcacgcatggactctgaaggtggggagccgacaggaagggctgagctgacaggtgaaagtatgagtccaggcaaagctgcctccctttcgaggaaggctgctcagccccagccagggagcaggaggacagacaatggctttgacaagcgaccggtcagaggacctgggaagcctggccagtgtggagcccgtggccactaatgtggcctccccgtctgtgtgctgctggggagccctcagggggaaggggtcacatgacaacaccagccaagctcatcttgcaaaagctgagagagaggggagctcccacacccctggctgagcacctctgccagaccctctgatgggttctgcatgaatatcctaaagaaggccagtgcgtgtgtgtgttgctgtcagagcccagctccattcaggaagggcaggaagggtccaacgcaaaggagagctctttgctgtgtgccaggcagcagcctccagagcgaggcccgccatctccagcaggatgtgcggcctccaagggaggcccccgtacgcagcaggatgtgcggcctccgagggaggcccccgtatgcagcaggatgtgcggcctccgagggaggcccccgtacgcagcaggatgtgcggcctccgagggaggcccccgtacgcagcaggatgtgcggcctccgagggaggcccccgtacacagcaggatgtgcggcctccgagggaggcccccgtacgcagcaggatgtgtgttcgggagtgagggaggcccctgtatgcagcaggatgtgtgttcaggagtgagggatgtgcggcccccgagggaggccccgtgcgcagcaggatgtgtgttcgggagtgagtgctctctggacattccccttgaataacagacgtggcccctgttggcctcccctgaatcgaagggcccaccacctcggtgcacgttaatccatgccagctcccagctctggcttttctcacctgatgtcagaaggaaagggaaaaaaatcggtgctttctgaagacaggtgcagccttgatcttccctggaaggggcccagtgggtgttcgctttgtcggaggccccgtctcggcagtgcctcactcctcttgcacagggaaggcagcgggggttctgtggtttgccaggggagcctgggacagtgacttaggcagttggagacgagcgccagaaccggggcgtgggccatggccgtgaagacgcacactgggccatggcccttggtgcccagcagggtgggaggggcgggtggagggtgatgccagggctccattctgagcagtgagagacttgcagttccatcggcgcaaatcaagagggcgctgcaggctgaagggaaagtagacggtgcccgcagttcatagggcagggagagtttggggtgcaggtgaagagccggcagctggacagccagcctggacctaggagagtgaggggccggcatcagggaaaccacaaagcatgataggaggaagcccggggcatgtaaggctggggtgggaaagtgcgtgtacagagagtgcgtagacggagagtggggtggccacgagaagaccctggtccctggtgggcgcccatccagagcctgctcatccagccgctgtggagacaggggcgtcacgcgactagcaaggggtcctctcacagcgcttggctttctgctaagaatccgtattttttcttttcagaaaaaaaaaaggcagaaaaagttgtcgtagggaaaaaaacgttctttccgctttttaaacctacatcccccttctgttccccagtgacttctaggatctccagctgttcctgtcacagcactgaactgtcctaaaagagaggcaaattgtgtctgttcccttggaccaaggcatttggtcctaaagatgatgttttagttctacaacttttcccgttccctcttagggactagaaacatctaccaatgaaagtttcacatgtgttgaaaagagcaggcttcggcttgtccgctgcactcggccctggggcgctcagattcagaaaggccgccagccatcgggtgtgatctagagcggcgttttcagccagggtcccagtggtcaccgtaagcgagaggctgtgaggcctcctacctttccctctctggagtcctgtgactcaccgtgtccttacgagacccccgatgcgtcgtgcgcctctagcagtggggaggattctggcaggcattctgggcttcccccgtgagccagtggcctgccgtctcccagcactctgctattccaaggcctctgctctgacggttcgaaaagggatggtccctgtttctgatgccaattgcacggttttgtcttaacctttcttttttctgttggtgactcaagtctcactgctgctccacaatcattttccagccccagtgactgttattgtcccttctccctctcggcaggagctggtggtggctctgagtcatcttgtggttcagtatgaaagcaatttctgcaccgtggccctgcagttcatagaagaggaaaagaactacgccttgccttctccagcaaccacaggtatggcgtcttctcctgtgaacccgcagagcacctcgcctggcggttctagtgcaggccgcggcccagtcttgctcaccctcgcagagtctaagcgcaggtttctcagatacctgccgcaaggggtccctgtttttctcatctttttaggcacctgccagatttaaaagggcaggaaagagggccacactgaccctcttacatttttcctttctttttaccctttttggaaattaaactcacagagaccttgaagtatgacaaaacttctgcagtaggagcttgcggaaaagcgcaggggccgtcttcctgcgatgagtaatttcatcacactgctcttggctccgtggctcggtgagtcatgtcaggcgtgctttctcacacgtgtcgttttgactggagagtacagttcctatctcatcgctgccggcagcccctcccgcttccacacagccgtctctgccgtgcaggggcttgtcatcagcagtgaggcctcactgcttctaggaagcccaggaggggagaagggtgagccagactgagtgtggacggtcattgctctgctgcggcttcccggggagcacggctcacggcccacgtcaccatgcacctcgtgtgcactcggacaggccgcagccaccagcctctcccctgttgtcttttgtaatttaatatgcacagagccacaagcggttgttgtttgtccagtgctatcccgcagagcctccgctcacgtctgagtctccctgagctgtgcagcccctgctctgacatttgttgcagcacaggtagcagctgccgtcaccgagtgtcccagctgctgagtgtcagaagacacgctggcctccacctggaagcccattgtaatttgtctttctccttctttcccagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatgtaagatcctggaaatcgggttattggattgggagagattggggttgttttttctgaaacactgtatctgagtaagcaccactctgcccctgccccttcgtctaagtgcgtgccctgaagtcccatctgccaacatggtgatgagtcacccttccagacgtgagcatggcaaggaggcgtaggccagcccccagaatagccagcgggcccgttaccaatgcggcagggagctcaagcgcagccgcagttgaggcggtggctccttggagggctgtgccctgcccccgtctcccagtaacctgtggtctgcgggtggggagcttggctcccagggagatcagtgagtgcctgtgcctgtgtgtgcgccggggcgtgtgtgccagggtgtgtgcgccagggtgcgtgtgtaccagggtgtgtgtgcgccgggtgtgtgtgtgcgccaggtgtgtgcgcgcgccaggtgtgtgtgcgccagggtgtgtgtgtgctgggtgtgtgtgcacaagggtgtgtgcatgccagggtgtgtgtgtgtgtgtacaagggtgtgtgtgtgccagggtgtgtgtactgggtgtgtatacgcgccaggttgtgtctgtacgcgccagggtgtgtgcgccagggtgtgtgtgtatgagggtgtgtgtatgtcgggtgtgtgtacatgccagggtgtgtgcgcaccagggtgtgtgtgtaccagggtgtgtttgtgcctgggtgtgctgagctttatttagaagaaaatatgtatctcagtcatgccattaactgtaagaccaaaaggagggtcccgggagcaccccactgaccccgttgcgtctcgggcagctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggtgagtccgcctgcccctttctgcttccgaggggccccgagggtctcctccccacacagagcagcacagacctgtgtctgcatcaggtcagtgggtgtcaaaactgtctgttcaaaagaaagaataaaggtcaacaggactgcgaggcagggagaacgttttgctggggcaagcgggaaagttgacatcactgttgtgttggggtagtattttacaggctgctccggagccatcggagctggccagtttggctgggtgggaaggctgccagaaccttccatctttgttccatagacgggtgagagttcttcatggtgctggacaccctggtgatgcagaacggtggttctcagccgggggtggttttgccccccacgagcaactggggtacagtaggggtgctccttgtcccagtgggtgaggccaggaagctgctcacatcccctggtgcccaggacagcccccacacagtgtccgcagtgagaggcggagggccctgcggtcgggctgggggctgtcatccccgccctgctcacctgcggaatctccacacaactttccctccatcccagcagcttgacgcagcactgcctggaaatggaaatctgacggaagggtcagattcttctcttgttctgccatgaatggtgtgtgcctgggtcctaccaccaggattgctgttgtaaaacaggagaagcaggaattcaccgtgttttcttattgtgtagctatgttcatcttcacactgctggtaacagatttagggcttaaccaaatgagcctcatctcctcttgttctgactatccagagtggcttaccggcttcatttgaatttttttcatgttaaggagcattttagccatgtaaaaatttacagagacttatataagagcgctgcgtgtgtgtgtgtgtgtgttgtgttcccagcttaaggaattacagaggtcgagccccagaccctaccccggtcccattccctctggtgacattacactttccctccctggccatgagccctggcacacacgtggtgcccacttagaggcctttacctcctattggcgccgtcgcacgatgcgtggcccgcaaagcccgtttctttggctctgacttcaatatgtatctttgatggtcatctaggttttgttccttcacctccgcgatctgccgtgactccattatccattctcctgtctggggacagtgaggccggttctagtttcttcttgccttttgttccttttcttaataagcaaactcagaattcagcccctgccaccatggagccccacatccaacacaccctcactcgctgcacccagctctgctgggccccagcctacccggcccccagcctgggcatcggtggggaagctcttctccggcatatggtggccgctcccctctcattcagagcccccatctggcagcaccttcccagaagcctccccagccccacgccccacctggaatcaggcttccccagctgccctctgaccctgctcccttttcctgctttatttttctcctgaggactgtggactgcagacgtgctgtacgtgtaacttgttcattggcccggcccatctctctcccctggagcttgagagccgcacgtgcaggaacccagccttgttaaccactgtctcctcccaccctgtccacacccagtgcctggtacgcagtaggtgctcaatacacataaacgggcacgtgtgtggtgcgtgttcttcagcgtggatacacgtgagtgcctctcgccaccttgcctcagagtgaagctgctgcgtgaacggtgcctgcaccttcagcttttgtagatgtcgccccaggccttccacgggatcctctgttctaaagcgcaggcgcccccatctcgccactctctaccacgccggtcttggccagcctttgtctgtctgatagacacacctggtgtctccttgtggcatgaatttgcatctgccttgattgcagtgaggttacagccttgcagccttacagactcgccttgtgtcgtttatctttctctgagtagtttgtaatcagcattcatcacagttctgggtgctgattcctggctgaatatatccatcgaaaatgcatctaatctatgactttttatgatgcctttggtgccacacaagcttaatcttttagtttctctttttctttataacttgggccttttgtgtcttgtttttcctattctcaatgtcctaaacatattctcctacattttcttccaagatttaaaattttccttttttgtgttcatgtcttaagtatatcctgaaccacattttgtctctgtggtgaggtggggatccaggttgtattttttctttatgccaccccagacccttcatcagacagcccgtcctcccgccagtgcttctcagcgtctccctggccatcagtccttagggtctgagtgggggctccattcttagcagcacccatcccatccacggccgcgccgacaccccacacagccgccccgacaccccacgcggcctcgctgacaccccacggccgcagcaacaccccacacggcctcgccaacaccccacggccatgccgacaccccacacggccgcaccgacacatcccacggccgcaccgacacaccccacggccgcaccgacaccccgcatagccaccccggcaccccacggccgcgccgacaccccacacagccgcgccgacaccccacacggccgcgccgtcacaccacagctgcgggggcagcacctttgagcccgctcctcagttcgtttctcagaactgtcttggccgctcttagccctttgctctgctgtatacatttcacagtcaggctttctgtgtcgacagcagcctcactggggtgttgtttgaatggcgctgaattggtggatttccctgggatgactgacttccttgcatcatgagtcttcctgctcctgaacagggtgtatctttccatttacttaagtcttctttatgtcttcaagacagtctaactttctgcataaaggtcacaggcatgacgttacctttcagtttttgtaattttaagtaatatcttttttaaaacctgttgctggcaaaaaaagaaagaatgccagtgggctgggcacggtccctcacgcctgtaatcccagcactttgggaggcggaggccgagacgggcggatcacgaggtcaggagatcaagaccatcccggccaacatggtgaaaccctgtctctactataaaaaaattagccaggtgtggtggtgcgcacctgtagtcccagctactggaggagaatcacttgaaccggggaggcggaggttgcagtgagcggagatcacaccactgcactccagcctggcaacagagcaagactccatctcaaaaaaaaaaaaaagaatggcagtggacatctgtgtttctctcttgagagtaaacgaaacctttctaaccttttacctttgatacgacatttgctgtagattttttgagtgggtgctctatatcagtttatagaaattcccttccctttggttcactctttttatgagtgcaaattcccattctattctagttagttaagaattttcctgataaatggaattaatttctttgaatgtattttctgcatctcagaatgaccctgtgcatggctgtttgttagggtagggaattacatgattgaatttcttgtgaaatatccttgcatttctgggggcacccagcgtggtaatgtcccctgacatcgctgccttacgctcaccagctatttctttgggcgctccccattggcattcacgagtgggttgggctgtgacttttcttgtcctgacctggctggtttagacattgagtctgtacctgcctagtaaaactggctcctccgggcatggtgacaggtgcctgtaatcccagctacttgggaggctgaggcaggagagttgcttgaattcgggcagcagaggttgcagtgagccaagatcacgccactgcactccagcctgggtaatagagtgagactccatctcaaaacaaaaacaaaacaaaacaaaacaaaactggctcaggagtgtaccctcattccctgtccaaaaaaactggctcaggagtgcgccgtcattccctgtcctcgggggcaatttttataagacaaagatgatgtgttctttcggtgtctgagtagaatttgcccctgaactgtctgggctagtgtagtgttgtgagggtgggtttgaattctgtattccatttctttaatgctgataggattatttacattctctatttcttcataagctagcttcaaaaagttttattcttctaggattttattcatttcagctaagtattctcattctttcccttgaggctgtctgcagtattctcatgagtctctaatctctgctgtctctttattgttttagctgcttttactgatattcccaatctgctgcctctttagatatgtccccgtttattcctattgttgtttatttgccttttcccctttttcctgattaatcctctaagatgtttgttcatttctttagtgtcttcaagttctaacttttaggctttgtggatttactgcattattttatctttatttttctattccagtactttattttgtttcctttctactgttttctctaggttcactctcttgtcctgttacagttctcaaacagaaaataaaaacagctcattaactttgagtttttcttccttcctaatgtgtgtgttcaggtctgcgggacccctgccccggctcccccaacccctgcccccgctccccccccgctccccccaccccccgccgccccgactccccccgccccggctccccccgcacctgctcacccaacccctgctcaccccgcccctgctcaccccgccgtctccgtctagtgagttttgatgatgggcttttcacttgtgttcagcttcaagctttctttctacttccattgtggttcctggggatggcggtccagccacaatgacagcagcgcatgacaggagcccaaagacccgaaacagacgcagggcatccgccaaggcagttcccaccgggcaaccctgtgggtgtgctcccagccttggccagctgctgccttgagcacctctggatagaacgagtccagagcttgcaccatgccctccagggtatggagaactgaaaggttcactacacaacaacccagacacgccagcttagcccagacacgccaacttgttaattttcattgagaaataacgttgcagctttgtgcatttggctgtccactaaaatatgccaagtgcccagaaagcgcagagttgactccgtatattcgagtataaatcaaggtattgccaagtcaccaatgaaatatattctaacgtcacttgtaagatgtttgttttgaactggaatacactttttaaatagaattaatgttacatatagtggttaggtttccaggctagcctgcaagagtcttttaaaacctgtctgcagaaattctacttataaatctacaatgaaaaaaggtatttaaaaatttttttttaagtactagaaaatgtaaattcatagtattctgttttgattacacatttcccctggccccggccacagctcctgtgaatagctctctagcgcctccagcaggttagtgccacctctgccccagttcacgctcatcaaggtcaaggtgatagctcccttccgtcacgtgtaggttagagcaggagtctgcaaactcttcctgtgaaagagctttgcaggtgggactgccccttggcacttccccaacactgccagtgtggtgcaaaagtagccagagaccgcgtgtaggtgaatgaacttggccatgttgctatgtaaccgtgtggactgaagtttgaattttgcgtaacttcacatcacaaaatattgttcctttgatttttttttcaaccacttaaaaagtataagaaccatacacaggccatagaaaaacaaggctgagttcagctcagagagcctgacagtagggcacaccctgcccgcaccctggcctccaaggatactcctgtgagtcagagggcttgggattctcccacggattggacagatattttgacagtgcccccactgtgcatgctggggcacaaaagtacagaacaggcaaacccaatgccacctgtgtcgaagccagtaccatcggctctgggcatctcccacccctccctgcagaagtgggcgtcctccctctgcagccaaggggaccggcgtttactcaggttgactcctggccaggagtcggggactcctctttgtgccccaacacatccttctctcagccgggcatctgtggccgtctcctccccgcctcgcagccacctgagccagcagctctggcctggtggtcgcagctctctcccgggtctccctgcttccactgtggccctcctggggccgtgtgctcactgtggccttccttttttttctgagatggagttttcctcttgtcactccagctagggtttaatggcgcgatctctgctcactgcctcccgggttcaagcaattctcctgcctcagcctcccaagtagctgggattacaggcgcatgccaccacacctggctaattttgtacttttagtagagacaaagtttctccaagttggtcaggctggtctcgaacttccaacctcgggtgatctgcgcgcctcagcctcccaaagtgctgggattacaggcatgagccactgtgctcgactggccttcttctttcacaggaagcgacagcagcatcacccctcggtgctcacctggtgaccgtctgccaagggcctggtggccccgccaccctacctggcccatgctccatggggttctcggttcactctcgtccctccactcacacgtatctggccatcaagtaagaatcaaaataaaaagttgcacctggcctgcaagtgtgcagaaccgcaccttttgttgatccaggaagctcaagccaggcagtgtggcgctgggtcaccatggcaccattgagagcttccgtctgcaggtccccacgcccacagcacctccctttccccctgggcatttggataccacatgggcatctccccttctgctggcgaaggctacagaaagttcacagctgtggagtttccaggtggctgaacttgctgaggctgctgtttgctgtgcgcgtgccatgcctgaggccctgggtgctgtccacaggcaagagggactgcggaggccccgcccaactcctgtgtgaaacttagctcttgtctgtgatgagtgaatgccgttgttatcctcggtactggtctcggtggagtacagggcgaagaatcgcagtttcatttgagggccacccagacgggaagcacacagcagcctggggcccggacacaggggcttggcctccatgagttttctcctctgccggttctttcttttctgtcttctcgaaggagctggactccccattccaccatccttcttatacaatgtgattcctgacttttttttttttactggagaaaactgagttttattcgtatatcattcaaatcttaggaaatttgacaggaaagagtttcacaatgagctggagtttaggaaggaaagaaaacaaagtcgcccctgcaaagccagcctcattcatattcagtgaggtgtcactcacaccacctggaaaccaccgtgcttacctaagtgtttagaagtcataacttacacagaatcccattgtgcacagcacttccctgtttccagccaatttcttctttcatttcagccaaagaacagcaatctctttagtcctttcagtgaagattgcagaggctttcagaaccatggcaacctggagagtccatgtctccccatctttcctggtgccccagaagccctgccccagcgcctccccatctttcctggccccccagaagccccgcccccagcgccctccctgctctgccttccccagagcacttgcattcttacaccctcagtcacgtgtttcctttcttccccgtggcaatgaagccccttggctggtacttggcttcctttgatcgctgatggagcccaggttcccccagcagtgcctggccctggtggggcaggataaatgtttgtgaaactaaatgggaacccaggtctcagcactgtgtcaggttctagaatcttctttgatgtctccatcctgcttgtttctcactcagcccttcgtctggcctgacatccacaagaatcccctacctcaatccctcctatttccagtgcccccatcccaccaggcctcgttgccctgggtcttgctctctgcagaccacaactgggcaggccctctttcacaccagctcctcaccaccctccaggtgaagccttcgttaaaaccgcattttctgtagaggccaaaccattgtctgacattcaaggccttccttcagcctcctgccccccgtctcagcagcagccgctccactgcacctgcccgcagcacccctggctggcccctggcccggcccctctgccatccgtgcagctcagagccaggtggtcttgccgggaggttgcctggcccaccgccaggatccccatgtaggtgcctgacccagtacatcaaagcatgatgtcgccatttttaccaccacagtcctataaagttgtttcttgctaacgcatggatgtgtggacacaggcctcacctgtcccggcccccagcccatgcgtctgccctctgcacttatctgtgttcctgacggccacaagtggccgtggagctgctcaggatggaaggatggctggagacggtctgtggcctgtgtccacatgtcccgggacccagcctgaggtgccctcctcacccccagacacccatgcatgtggccccacaccatgtcactcccacgctcatccgtccagccccagctcccagctagagtgcagtcccatgggggaccacgctgctgtgtgctccacccgccttccctcccgaaaccctgcgtctcggccagagtccaagcacacccgtgctgagaggcgaggcgggagttaattctgctcgggactctggtggcctgagaaggctcttcccgcagaaacagcctcatcccgagagcgctggcaggaacgcagatcagaggcctgggctagatgggaccagttttcacgactctgctagatacggtgacattttttacggttttgaaaatgagttaccatagaaatggatccaggatggactaatgcaagggaggggagggcgagaaaggaacacagccctgcggagcctggagccggccctggtgcagctgtggcaagcgccctgctcacccagaggaggagctgggggccctggccagcggcagagccagaagccccgcaggccgcctgtgctctccacacctgaacacgggattctgcgggagagctggtgtcaagtcctgacccctctacttcgttccgaatctgggagccagaactactgcctttggaggaaagaggagcccggagacccgagcccagaaactggggcactgcccggctcctgggaggccacagaacagtggcggcccctgcaccccaggcctgcccaggcctctcagccgcacacattgcggccggctgcactgcggcatcattggtgttcacaggacgggccatagcaactgcttctcccttggtttattttttaatgtttcttaaagacggggtttcgctgtgttgcccaggctggcctcgaactcttgggctcaagcaatcctcccacctcaccttcttgggtacctagaactacagtttccttccttttttccaaggcatcgagaagctgaaagagtccttacaagccccgcgtgcagctccagagacccccagtagtgagttccggccaggcctcgaggtctgggtttcagggcagagaaggtattggtttctgcctttgcagaaaaaaagcctggtgctcgctcaaccaaaagaaaagctaggcagggtttttgccaaaggaactgtgtaggtttggaaggaaaaggcttcacaacccagaaactggagttactcttgtcagaagacggtggtgagaaaatgaacaacagttttccaatgctacaggattatgtttttaggacaaaagtccttaactaaaggccattatgatgtttgtctcgtaggggtactgaatatgctgagaaaacgatgcagacgcaccgcccacccggcccgggaggtgctgcgtcttccctgtgggcagctgcagggcccacggctccggccggcccaggaggagggagggcggagcggctggtcagcgtgattctcgtaacagccacaccgagttgtgggtgcagcccctgaggggtcaggaggggtcacaggaaaggggccgctgcggaagccctcggcctggggcactggttccccaggatggcagagggtcttggccatcacagactgggtgagcacatcagagggcgtaacccgctctgccaacccctcagccttggggtggcggctggcagctgtcacctgcaggaagactctgtcttctctgaactgctccgacagccggggagcttctgggattcagagtcagccagagctctgagtaaatttccccgccgtgtatgctatttggaaagctgtggccattgggctctgaacaataacttctaaaaccattcattatgatcttttattacttttagtctagacatgaaaataggttctccgtgcttacagggagttctgtgagtgccagcaggggccctttctaagctcaacatccccggtccctgactccctgccgggcaggacccaggcagccccacctccttcctggtggactcgaatccgatgggaagttctctgcggtctgttttggggactggcagattttacaacaggacagttcatacaacggagcctgagagaagattgtggccaaaccagggaaagacgtgaaataaagacagcagttccgtgatcacagcgtcatactttttactagtacatagttataaaatccactgtcactaaaaagactggcaaaaattagatttttttttcccctgttgagtcgcaaacagtatttcgactttgatataagtggaagtctgcacgaaggtcgacaacaatagcgttggccctcggtacgcgtgggggactcaagggcccagggcccacgacgctcagtcctgctaggaaaggcgtgacagctgtgcatcccccacacacatcccccatcgtgcttgcatcttctctagtttccttataatgccaaacccagcacagtgtgtcaacagtggttatgctctcttgtttttttttttatgtgtattactttttgttttgttttcaaatattttcgatctgcggttggttgaatccatggatgtagagggccaactgtaataaaaatctgtttttaaaaattagatgaaagtggccaggcgcagtggcgcatgccggtaatcccagcactttgggaggccaaggcaggtggatcacgaggtcaggagatcaagaccatcctgcctaacacggtgaaacccgtctctactaaaaatacaaaaaaaaaaaaaaaaattagctgggcgtggtggtgggcacctgtagtcccagctcctcaggaggctaaggcaggagaatggcatgaacccaggaggcagagcttgcagtgagccgggatcgcgctgctgcactccagcctgggcgacagagcgagactctgtctcaaaaaaaaaaaaaaaaagttagatgaaagtagcagctaatacatctcacacacacccccaccccgccctgcacattgccagggtccttacctggagtgtcctgtggagccctgacctagaccccgggtgtccgcgtctgtggcccccacattgtgggtgaggcttgagcagccaccagcctgcaccctcctcgcagtctgccagggccgccgggagtggggggcctcctgccgtgcctgccctgggttccgggcttgcccagtgccctattcttcacagtggcctggtcctcacccccgggtcttgtgaggagggttctcatataaggccagctgcccctcacagccccttcacggggcagtcgagcctcgtggggagctgcttcaatgcctcactcagctgtggggagcccaggaccccagaataatcaaggggagtgggtctcaggtgggcagtcatcaacgggcatcttacggggccatcctgtcacccatgttagagagtgtcgtggagctaggcggtagcgaacttcgccagtgaggccgcatctcctcctcaccagggcctgtcgcgggagggaattcaaagccaaatctcctagcccacccacccactctaaaaaaaaaaaatgaggacgcagccatcgccgatgtccttgtgttgcacggagcagttcctaggagccggctccgctggggtagaggagactctagggatgttcctacagtctggaccgattttacatttccgagacttgcttgtggatctacacggctatcgcagagctgtgcaatctgagagctggaaggcttcggttctgtcccagtacacgcggtgcaggaccacggttgagcagaaggtgcatctgcgtggcaccgtggcgctgaagtccaggtgtgcttgggccctaggctcccaagacgttcccactgcctcctcctgggcacaaggctcaagcacagggaccgccggccaggcacacatgtgtatgggcaagacccgcaggggacgtgtccctgggaagaatgcttcctttggttgaaggctgtaaactcgccctgtgaggtgagacatgtcagctcccagaaaaggtcccagcctctcatgattcacgccagcacaggcagcacagcagcagagcgtgacctcctagatggcagcgtgacctcctagatggcagcgtgacctcctagatggcagctgagctcaattccacacggctcagtcctggagacaatcactcactgcaacacgcattcctcatgggggcctcttcaggagccacgggcatggggcttccctgacctctgcactcacggtgggggcgcgcacagcaggggtagacactggcccgccatatctggagctgaagtagagcccgtcttgggctcgcttagcggagaccataggtggaggtgagccagtggcctcaggcatctgcagaacccacgcacacattgactttcgcacccgcctccatctccgtggacttgactgtgtcgtgcaaaacccactccacgtgcgcagctgtgttcctgcagtgacacgaggccctccactggctttcgatgcttcagctctttcaccaacaatcaggtggactggaatcacacctcactcgaaaccctttgaatctctatttagtgaacaagcacttgcttctcagcaaattgtctagcttccccaaaaataaagaagatggagttctgtgtggctggatcccttttcagctcccagcactgagggcagggccctgtctgcctccgcctctgggttgaagcctggcagtaaactggcactcctggtgcccgcaggcaggggaggcagcgcctggccccgctctgccctccacgctcagcgcctctggtcctcggcccagcccttgctggacatgcagcctctaccaggattgctgcttcccttctcggcctctctgggtccagcgtggcgtggacaacagttcggcaatgcctgctccatcagcctcctccctggcctcagccaatgctgactgtgccaggagcccacatagcccgtgcctgcccccccttctggtttccaagtgctcacagcctccaccccacaatctctgattggctcctgcaggcttccgtcaggtatcccccaaggctccgcgtccccatcacctccgtgttttattgttcaatgtcttagatcttgtttgtgctaccccctctcgctccacccctcctttgcccagagaatgatcctccttcccttcaaagcccagctccttcgtgcctcttccaccaggccttcctggccttcacttcctagcccactgctgacagaaggagtcactctcgctccttcctgcatctccctgaggccgcacgctgtcgtggacgtagcatggctcaaaggtttgatgggtgtgcgttcacatccttcatcctctgggcctcaccttccttggcgacgctgggggtaacacctgcctgtaggattgctggggaattaaataggaccgagcagccgcaccgacgaatcctcaccgacgaagcctcagcgcttccctccatgcccacgactcaccagtgttatttataaatgagtctgagtccctgctgggtcctgccttgtctgtctttgtatccgagtatgcagcacagaaccttgcattgagtgttgggtgagtcgggagaggcttagggacaaaagtcacagcacatcaacctttcgtgaagtcctagcatctcagagcagggccagtgcctggaggtggacaggaagcacgtggaggtgggcaggaagcactccctgggtcacagtgcacagcagcacgtgctgaacttggtgcagtgcagacgtccatgccacatgcaccactacccatgggctgcggcagctcctagaaatctaggatgtgacatcagacgctcctccgggagtgtggtcatgccctccgatccgctgaggcatttcaaggaaagttacaccctttccaacgcagttttccttttagaaagatttggcctcagtagatgaatccatgtgatcaagcctagtgatcagctaggattcttgaatctcgggacccgttgccagaataacaaaatgggggcttcctgtaacctcggctctttaaagcaacacttctgataccagggttagggtttcagaaaatgcagccgccttaggagcctcattggcagctactttccactaaaacatcttccatttctctctctcaggagtttcctttaacagtgtttacactcagatttggagagtcctgctgcacctggctgctgacccctatccagaggtctcggacgtggccatgaaagtactcaacagcatcgcctacaaggtacgtgccgggcgctccccaccgcgctccagctgctggttctcggttacgagtatgcatgccaggaactccaggtgtgcccgggtccacaccacagtttagaaagtaacaaaacgagcttcagcaaatatcttaaatctggagatgtacacagtacaccccaaactgtgtctgtgcagctcccacgtgggcagagggtgctggatttactgatgcctgtcaaggcaattaggggaggactgacattatctttcaggatcctctggtgtctgggtgagctacagtgctggcccttcttccattttttttttctttctttacttaattatttataagagatggggtctccctgtgttgcccaggctggtcttgaactcctgggctcaagggatcctcctgcctcagcctcccaaagtgctgggattacaagcgtgagccactgcacctgttttttgtttttgtaagacagtctcactctgtccagactagaatgcagtgacctgatcacggctcactgtagcctccaactcctgggctcaagcaatcctcccacctcagccttggaagtagctgggactacaggtgcacaccaccacacccggctaatttttaaattttttgtagagacagagtctcagtgtgtcgcccaagctggtctctaactcctcagttcaagtgatcctcctgccttggcctcctgaagtgctgggattacaggcatgagccaccacacccagacttttcttccctttctgatagcagtaatttttgactcattcaaaacccttctagttaatggtttcttattcatggccattctagctcaagggaacttttcaaagaatcagtttttggtttcattggtttttctctgttgtttgtccattttccatttgattgattgagctttcatcaataaagcttgctttcttctgcttactttgagtttaatttgctcttctcatcctagtttcttaaggtagaagcagaggtcattgattttagtcctttctctttggggactgtaaactcttctcagtcccttttgtgagctctgggcatttggcctaccgccttcccgctgttttttctctgcctcatgggttgtcactctacccttgagcagatgaatacttagtcaaagaccccaggggcctctcctgcagaccttggaagctttcccctctccagtgctctgtcctgcaaattgtcaccacctcagcctccctggagccccagtctctgtctcctgttccctgaaagtgctgggctccccgtctctgcactgtggcctgggactgcctgaaactacctgcaagccggacacagggcagctgtttatttccgttctctcagggatcacaagcccgtgacacccagcacccagtgtccaaaaacaattgtttacggtatttgtcctggttttctagttgcttatggaagttggatgatttatgtggaattagaagtcactcattatagcacttaaaaattttttggtaactttttgataaaacttcaaaagcttacagaaatgttgcaggaagaatgcagggaaaggccacactcttgcagcctctgtggtgttctacgtcttcatctgacctcgtcacggctatggcgttgcctcgggtatcactcagtgccagggtctgcagggtcgaggagccacggcttcccatcctagtccatcgctttttccaaatgagctatcgagtctccccctctcatttgctgtggccttctgggtcctggccggccatcgagccagggttcctgcagctcctcagctccttttgctgatattatacttctgtggctttcggttccttcaactaagttattttctgttggtctagttatatcttagatggaaatcaccttaccgtctgcagttggttcttcttcagttctttttttttttttttctcttgctctgttgccaggctggagtgcagtggcacaatctcagctcactgcagcctccgcctcccaggttcaagcagttctgctgcctcagcctcccaagtagctgggactacaggcgtgagccaccacacccggctaatttttgtatttttaggagagacgaggggtttcaccgtgttggccaggatggtctcggtctcttgacctcgtgatccgcctgcctcggcctcccaaagtgctgggattacaggcgtgagccactgcgcctggcctgttctttatggtatcaccggtatagtcacaagtagcctattggccaacttggaaaggtccagattgtttaattctgcaccggcctcccctcctgcagcggactctgccacttccttcgtcaccgcatccctgcagcggattctgccacctccttcgtcaccgtgtggtgtggccagctgcacgggcacctggagacgttcatccccaggcagcaggccatctcctcaggtttcttttatgtgctactggcctgttgaaaatagccagtcaattaagttaatgttttcattatgcggtaagaaaactaagaaataatataattatttgcttttaaactaggaataagataaatacaaaaataaacctcaggctgggtgtggtggctcacacctgtaatcccagcactttgggaggccaaggcgagagacgatcacttgagcccaggtgttttgagaccagcctgggaaacatagtgaaaccccgtctctacaaaatagtagcaagttagccgggcacggtggcaagcacttgtggtcgcagctacccaggaggatgaggctggaagatcccttgagcccaggagctcaaggctgcagtgagctatgattgtgccactgcacttcatcctgggcggcagagtgagaccgtgtcttttaaaataatgtttaaaaatatatgtttgttacacattatggtctgagaccaagaaggggaggcagtaaagcagacaggaaggaaataaggaagaaaagaaagtcataagactgcacaaacacccctgaggaaaccacccacggaggccccagaccagagcaaccggtcccgaggcctctcagatgagctgacgctctggaggattgggactgaaaccgtcacatctgcctgctacggattagggaaaatcagttcttaccacttaccactgcccttttagactctaaatagcctctaccacttttagtttaagatttcaaggttgggttttaaatagccgttttcactaaaatagttgtaaaagctttttacgaacattaataaatggtttaagtttttagaattgatggccagttcgcgtctctgctggcagttctctgacacacaggagtgtctggtggcctcttcttttctcttggaggcacaggatggctgtggccatggaccacccttgctctgtcctgactgcacagttggaggccagcgctatttaggaggtttgatcgttttcccccaattaatttagcttcttgggtattttgatcatgatgaaatcagtattcagcctatttaagtttatttttcagtggcttttgtgtatttaaccttactgaaaaattagcctgaattattttaaactgtaatccgagtgcctaatcttgaaatataaggactattaagtgcgttcctgtggacctggcctccagttgttaaatagctcctcttgggaagctctcgagcctgtgtagcacagaagccactgctctctgctcttcagcaaacgtcccagcacagcctccacagcccagcgcccttttggattgtgtgtgacatgtagtgtagctggacggcccgcccccctctcccaccacggtaaggcagttaagcacctgcgtctgcctttcatgttagcaggttatagcaactcgaacacacggctttgtcgtgctatccgattgagacccagaaaccgccataaaagtggcatttgccttctgtgcctgctttgccgttctagaatgacacagagaccttaaggcacatggccatcactccagcagacatgccacagccagaggggtggagaaggtcaagagaaggcctctgctagagaccttgctatgcatagcacaatgcagcatgagcttgtgtgtgtgtgtctgtgtgcgtgtgtgtgcacgcgtgtgtgtgtgtctgagtgtatatgtgtgtgggtttaagagtaaacattgctactaaagcatttggaagcataaatctttcttgtcttcattttaatttcaagaaatgccttattttcctgctctaggaactgaagggattacatttcattttacagagaaacgagcctattttagatatttaactctgaagccaaatttttgttcatcagagtctaaaacagccttattactatggaatgccctgtagaattctatattcaaatacagaaattgccaccagctctgtatgagagaacccacacagctccagagctgtggtctgatttcatgtatttataatatatttcgattcccattccatgggcttggggttttcattttgcttttagctcccttttctcttggtttagttttgggggtgttgtttgtttgttttgttttgagacagggtctcactctatcacccaggctggagttcagtgatccagtcacggctcactgcagcctcgacctcctgggctcaagcgatcctcccacctcagcctcccaagtagctgggactacaggggcgcaccaccatgcctagctaattttcgtattttttgtagagatggggtttcaccatgttgcccaggctggtctcaaactcctaggctcaagtgattcacccacatttccctcccaaaatgccaggattacaggcatgagccactgcacctggcctgcttttaggtttttttaaggaaaatttcagactatgtagaagtagaaagaagagactgatgcccctcaggagcctgcctgtggccccagcagttctcacctcagtggttttaggacaatgccaagaaagaaccttcaagccacaggtggtcacctgtcagggcacatgttctcatgatcactgcttatattataatttatgagaaaacgtgtgagcataaatgcacaaactcacctagaagcaccgctgcagcctcttgatactgtgaagagtgtgtgtgcatgtgcgctggccgctgcctctgttgcaggactcatgcatgcagacggagatgagaaaggggtgtacttaacgaaaggtcaaattgatggcagtggcagccagtctgggagcggccactgccatgatgccagctacagctggggaggtgtggccagggccgtgtgctccacaaagctggcaggaggcagggaccggtggaatcccacccccttccaaactggcagggtgggagcctcatgctccccaggtgcagctacagccacccagccacaactctggatccaggcatctctgtgctcttgggggccgggagcaggcaggaaccccaccctcccaggcacagctgcagccacccagccgtggctccagacccagccatctctgctcttggggaccaggagcgggcaggagctccaccctcccaggtgcagctgcagccacccggcatggctcctctgtgctctcaggggcccaggaagtgcccctacccctgcaggcttggaagcgtctgctcccgctccctggcctctccctgctcctggcacccacttcaatctcggagcaaagttgaggctgtacccaggtgctgttgcaaccagccggctgtgcacacgctcggggcagtgctcacatgccaaccacctgctatgtcagccccctctggactttgggcaccaacgagcatgggagggaggctgagggtggggactgagggcagtttggcactggcctgcaggtgcccctcggcacaatcagcctgggtgttatggatgatggcaggaggcagacagggtcctgggcagaaaggggcaggtccccagtgaagtgccaccttcaagccagggacagcctgaagcctgggggctgggctgatggaccagaatgggaacttttagtgctttttccaagcctgcccatggctgcccatgaatcagtcagcacatacttcctcccctttgaagcccataaaaaccctggactcagccagactcaaggaaacgatggcataacctgccttcagaaaggagctacccatgccggggtctcctctctgctgagagctgagcagacgttgggaaaaccagctgcagagaggagctgcacactccagggtctcctctctgctgagaactgagcagacgtcgggaaaaccagctgcagagaggagctgcacactccagggtctcctctgctgagagctgagcagacgtcgggaaaaccagctgcggagaggagttacccactccagggtctcctctctgctgagagctgagcagacgtcaggaaaaccagctgcagagaggagttaaccactccagggtctcctctctgctgagagctgagcagacgtcgggaaaaccagctgcagagaggagttaaccactccagggtctcctctctgctgagagctgagcagacgtcgggaaaaccagctgcagagaggagttaaccactccagggtctcctctctgctgagagctgagcagacgtcgggaaaaccagctgcggagaggagctacccactccagggtctcctctctgctgagagctgagcagacgtcgggaaaaccagctgcggagaggagctacccactcctgggtctcctctctgctgagagctgagcagacatcgggaaaaccagctgcagagaggagctacccactccagggtctcctctctgctgagagctgagcagacgtcgggaaaaccagctgcggagaggagctacccactccagggtctcctctctgctgagagctgagcagacgtcgggaaaaccagctgcggagaggagttacccactccagggtctcctctctgctgagagctgagcagacgtcgggaaaaccagctgcagagaggagttaaccactccagggtctcttttctgctgagagcagaacacttatcaggacagtctgcctccggagaggagctaccaactgtgggtctcctctgagctattctgttgctcagtaaagctcctcttcagcttgcttaacctccacttgtccgtgtacctcattcttcctggatgcaggacaagaacttgggacccaccaaatgtcagggctacaagagctctaacacaaacagggctgaaacatgccccttgcttgccactttgcagatgacaagaaggagagaagagaaaaggagagaagagctgcagcccttcagggaacccagacctaggagctccctgagatagggctgtgatgccatctctggggctctgcagttcctggcgtctccaagcttccaggtgccaccacgttccccagtgccagatgttgaagctgcttgtagtacacctggcccagccacagccttgcagggagcaggcacccatgccagtgcctagagctgcccacccccctgcagccagcatgcatggctgcgcacagtggctggaccccacattcactctcacacccctcaccactctgcgcctggcttgcctttggcaggtgtgagatgcgggccagcagtgtgagccaagcgcagcctgccaggctgaatgggcataacaagcccagtgggtccaagtaaaaactcgggcaaaggcgtcaccagccacagaggtttctggctggcaaagcaataccccaaggatcccatgacattttgatttacttataaaatgaagacctaagttactgataaagtaaataaacattggccgagtgcgatggctcacacctgtaatcccagcactttgggaggccaaggcgggcggatcacttgaggccaggagttccagaccagcctggctaagagtctctactaaaaatacaaaaattagctaggtgtggtgatgcactcttgtagtcccagctactcaggaagctgaggcacaagaattgctcgaacccaggagacggagattgcggtgagccaagatcacaccactgcactccagcctggcaacagagcgagactcttatctgaaaaaagtaaaagagaatgaaaataaagattgagatatccaggaaagcatattccaaagcaccaaacatcctaagcctgatgcctggcttcatgctttcgtagcatgagttacttatggataggtttcattttttttttttttgagactgagtctcactatgtcgcccaggctggagtgcagtggcgcgatctcagctcactgcaacctccatctcccaggttcaagcaattctgctgcctcggcttcccatgtagctgggattacaggcacgcgctaccatgcccagctaatttttgtatttttagtagagacggggtttcaccattgttggccaggctggtcttgaactcccgacctccagtgatccacctgtctcggcctcccaaagtgctgggattacaggcgtgagccactgcacccggccatggatacatttcttttaaaatcacattgtcatgccagaattttctctcctcctacttgacagcctctcttagaacccagagagcccggtctgtgtctccctaccctctgttctctcaagctgcctgaatcgtaaggatttcttaattcagcatgtttgcaattaacctctagaccaaagtagttctgcactgctaaaactgtctttacctctgaaattctctgaaatttctcttccagtgatctcagccgatctgcatatagatattctgatttctttttaacctcgtcaaatggcatttccttaactgagacagacagttctctgttgccaccgtgatccctccctctagaactgcacctctctgaagccattggactctctcccagctcagggcccctccgggaatcgtgagctctacgtccagcccctgaaggccgtgctgcccatcccacccctgcctggtttcagcggtggcctgctgtgtggaagtgtctgactgcctctcccaccaagccacgggcgtgcacaccctctgcatcctcagcaagcgttcacctcacctgtcttagttcctgcacctccaccacaaggatggatgctcagaacagtgggatgagccgccccaggaatgtggcatgccagcagcactaatgaacatgaacagcctggacacatgtcacacctatggcttgaaagcttgtcatgcacatgctcattcccctcactgcagacctggggaacgagggcagcatcagcctggactagcatagctacagaatcagatgtggccctgccttagagccacgctgcccaatgctggcccgtgggcccctgcccagctagagcagaggcacccctggatcgcccatccagacagagatgccctgttcccctgcggagatgcagactccaggctctggggtggcggccgggaatctgttctcagtgagacagtactgtgcagctgcaggcagcggctgccccacgagcaccctcgcgggggtcatagccacgagcaccctcgccggagtcatagccacgagcaccctcgccggagtcatagccacgagcaccctcgcgggggtcatagccatgagcaccctcgcgggggtcatagccatgagcaccctcacgggggtcatagccatgaggcactaggttggctcttggagcctggggctccttcaggcaaggacaagcaccagctttgccctgagccccattctagttctgctagctttcagccagtgacttcatgcctctcagcttgcatttctcctctataaaacttaaaactgggatcattgtatgactcccaccccctagggctgtggtaagaaaggcagagccccgtccctgtgctgcctgggtgcagcgggggctccatacagcaagctgcatcgtcagcactcgtgtctgtgtcctgtgccgcccaggtgcagagagggctccacacagccagctgcatcatcagcactcatgtctatgtcgccatcagctccttggccatctcaccatcctctgtggaaaaggggccacagcaactccagaacctcccgagccttcccacacacccgggtctgaggagggaaggagctggtgggctgagacacctcggcctccactgacgcggcgttctcttcccgcagcgcctaggactgagggcaccgtggccccaagtgaaattccttaaggcttcctttgtaactaatgggcatcttgttaagagtcaccacgttgctttaatggaataatacctaggacttacttttccaaaagaagagttcgtaggatttatctaggaaacgcagtttgcaggaaaatgacttgaagaaatagcagcacacgcttttgcaggggtttcttctcccccaccaagcagccagcggcctctgcgctattcttagcccaaaagtgcctctggataatcctctgggaatccctttttaagagtttctcacacatgaatccagatcctcgatataaaattaacaggaacatttctgaaatactccacttcctcccaagatagagcagccagaagctgacgctggcatccgcagccctgactgtgtcaagatccagtgggaaaattcactgtccaagtctctgaaatgtacggtattttcatctgcattggatcagacgcccccgtgtccttgtgaggtggcgctcccggaacaggagacagggtgggtctcattccagtccccgcttcagcagctgcaacagtcgggggtggataaaagacacctgcacctccatcttccaggcgtgttcatgtgcgcactggcccaagagagtgtctgtgctgagcattcgactgttagcaaagtcgtatctgccaccaccgaaggttggcttggggagtggaagaaaggccctgtcttgtagccgggaccttgaccctcttacagctgccgtcctctctggacgcagacctccctagagggcatgtttgcacacccttgacctctgcaggctgcgagtgagccggggctctgggggtgtacatgctgagaagggcgccgtgtcctccaggcaggcctgggcccacagaggctgtgcgggccgcactcagccctccagtttgcatctccaaacccagcctctgccattgccgtgccctctctgttcacccttcctggtgctgcgctctctaagatggtggcagggaccagcagaaaggactctccctggtcctctgcctttgcccctgccccagccagctctgcagctcctgctcgctgcgtaccctgtcctcacaccgacaccgcaggcaggcaggtctgccaggtcacctctgagggacacgctactcatgttcacaatcttggccccacacccagcgcaatcaacgctgagtaaatgttgaacaaataagaagtgcacagctaaagaaagctccctccaggccaaccccctgtggtcactacactaatgggggtggggggggctcctgatccaggtgtgtgtctgtctcacgagatttccagaagtggtggaaaattagttttgtgacagcagccccaggtacaagccatgtgaaagcaggatggtctcatcttataaccccaggggctgcgagaattcatgccgaggcccggatcagttccctgcctggaagagtgggcagagcagagggttcgtcaccacggctccatgcggtactcccacgggcgcttccgtgcagggtggcaaggcgggagctgcacagaccccaggcggctcagcgtgacgtcccagggctcctgagtcaccggccccagcccagcagcgcctgagcctttgtgctccgtgagcgtctgagcatgtgtgggttttgctaaaggcttcatttcaactccagaagttttctgtcttccccgtcacctcccactgtttttccagacattttgagaaggcacatataaagttcacagtcgaaaacttgcttttctctttttagacttttgaagggatcatatgtctggcaggttctgtgggatggttgtatgtgtctagggctggccgaatagtttaataccaaaacaaaacaagctcagaaagaacatgtattactcttgtcatttaaaaaataggaacgttgcttaaagacaagttatggttccattttcttgctatttgcgttttgaaggaaaggacaatctgggaagcgtgggtgttacatgagtgaagacttcaggatcgttttgttttccttggtgttctgttggctgaattgcaggttcaaggttcctaaattctaagtgaataattaaaagcatgagacattgcaggctccacgcggatgcggacctgaaggacagggttctgtctggctggagcgcagcctgggatgggccggcgctcagggaatggcttgtgcctgcgggatcagtgggcaccttcatggagcagctggccccatcctcctgacacagatgaggttgccccagcaccatcaggccccttctgaacgcgcacagcctctggagtccagaacccagcgggacccgcattccccccactgagcagtgtactcagaacaaaaccaccccgaagcacctgggccctcgcgaggtcatgtcggtggccgggcagcgcacgccctgccttgcgtggtttctcacggctgctcactaacgccgacagctggtctccagatccacagaaaaccctgctttaaaaaataaaagcaaaacctcttgcctcctgaatgccagggctcaagctggtacaaatctttttctgtggtagaatttcaagccctgcaggtgtctgtggcaggaggctctcagagcccagggtcttggcttcatccacagacggctgggttgaaggggtggtttggagcctcatgctgcccactaggctgtgccagctgtgcaccaccctgctccccaccctccgggagcagccatccccttcccctgccagtgcgcccctccccagggcaggtttcagccatgtctgccctggagatgaaggttccccgtccatgcagtgcacccagcaccacctgcgtgcgcccgtgggaaaggatgaccacagcccctcggccaggaggatgttaagggcggtcttgagttccaggccccgtcacagtccaggcagcagagcccattttgccactggagagagcccaagccccctgcagtcattctctgacagtttctgtggcctcctgaagcacacgggggtgtaaacagtggcctgcgtggaggcctcaggctgctggtggctttccaccccgtgcccaccggccaggtcccgggtggatgaagcactccctgaccctccgtgaatgccacatcgcccggctccggaaagagcatggctggtggattcttcccgggcctcaactcgcagcctctgacccgagagctgaggtgttggggagaattggactcaaggctgggacagtgtggaggcccagcctcaggcaagggggaggacactgaggccgccaggagccgcccctctggcagggaaggtgaggagggtgggccgtcatccatctcagaggcttcaggccctgacccctcaggagcctcaggcagagcttcctccccagacatcccggctcacacggccacgccagggctagcccagtggatgcatgtccaagagtaaagaataccacttgagcttcaggattgcctttgcgggggatccagctggggccttccattggtgttggtgcttcctcggccaaaggccttttctgtgattctgaagcggctccacgccagcctctgcttcgtgtggcggcctccgcggagcacgtcccgtctgaccttcacacccccattcctttgcccctaggccaccgtgaacgcccggccgcagcgcgtcctggacacctcctccctcacgcagtcggcccccgccagccccaccaacaagggcgtgcacatccaccaggcggggtaagtgccgcccgctcagcctgcaggtccgtggtggtgaccggggccccacgggctgagctgtccctgagccggcctccccatcctcctccttccccgccctgtcttggcttcgtctcctcccccctctccagcgggcgttctttccctctccctcccggacaccccggtacccgcctgatctgagccctgccttgagctctccccatcttgaggaacccttcatgtgcacatcatctcagcaaaagttgaatgaagcctggtctctgtggcctttcagagtttgtaagaggggatctagatctccaaatgggtaaccaacaggtgtttgcacctcaggacgtggcactgctgtgtgctgagctcgcacatcccggcccactcgactctgagctgggttcgtcctgtccgcgccacctcccagggtgctggagttcaatgagggacaaccctgccccctgccaggcgggcaaccgagcagcatggactcggcaccagcagctggggttcgggagccatgatggcatgctgggtgactgaggacaccccgggccctggtggcacctgggagggtgcaggtggcccaggaagttgttccatgttccctctcgaagccccagactctgcagaggatgcagtgtttgtttttcttccaatggcaggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcaggtacgggagcccggctgcctggtgatctggacactgagagcgttgcttctcagatgggggctcatggcctcagcctcaggctgctcacatcaccatgggatggggcaggacccaccctgccgtcctgggtctgtgggccactctctgcctttgcagacccgggtgctggtcctcactcgtgcacccctctgcctgcactccttaggagcactgctgggtgtgtcccggtccctctgcctgcactctttaggagcactgctgggtgtgtcccggttctccgcccctggttctggtttcaccattctgggcagcttccatgtaacgaaacaggagcacggagttacctggctctgcccttcctgggcacacagcactctgcgtccgcttgggggcagctgcactgcagagcatttgttctgaatgtgttgtcttttctgtgaacatccaagtacgctgcataaataggtacactctctttgcctttaactaagttgaaaaagatatttctggagagaggaatgcctgctttgttttgccagggttatgagagtggtgtgaggtggcagctggtccggagacctcggctgtctcgtccaggtgctgccactttgtcagttgagggcacctgggctcaagaaggtggttcagggcgcacccagcacacccagctgctctgggtgctgacagcatgatcatctcagcaatgagtggggtccggggctcgcttggtaatccagtgattttaaaagaagttagcggccgccttgcaggatgccctggagcaggaacggccatgttggggtagaagagctgtcacggcaagagcggacaggtccccacaggtgctgctcagccccagcccacctggactttccgtgtctcggcagaggaggagcgagaatcaccaccgagccccaagtgcagggtcagcctcctggccaggccctggggagcaatgctaccggcacgtgcagctcacccacccgaccccccggggtgggggggatgcacctctcactgcacctgccctgagatcatggggagctccctgtgccaagacacagcgtgagagacgccagcaggccacatggcgtggcacaggagacccctggtgcccagcctcactccacaagcacacacagactctgacagccctggccgccacaggttccacaacaggaaacacccaaagctcagtcctcctcagctccacatcctctttctccagtagctgggagctccagccggcctgcaaagctgtgcgctccgtccaggccacttcacatgggagtccccgctctcagtctggtgtcacggggccatcacaggagctgtcctggaaccaagcggcagaggctttttgggggttgataaaccagcacacatggacgcacgtggcattgtctgaacagtcagttagaattgacttgggagctgtgctgggtcggccctggggatggtgggaccgacgtggctcacacttcacagcccgggcccctcaatccctggccagacgttcaggggttcttggtcaccaggatacggaagtgagcagagcacagaagtgccgtccttaggggcagcccggtgctcccggcagcgcctttgtccccagctgcagctcttttgagctcaggagtggcatgactgactggtgtttctttttccttccaaccctcctgcttaaaccctgaagactgcggacgacgcggacgatgctgctggacacaaaagtttcatctccgccacggtgcagacggggttctgcgactggagcgcccgctattttgcccagcccgtcatgaaggtgcgcccggggtgtggggttcagagtagagtcctagcgaacatgtgtctgtcccacttctttgagcataaacgctcaaggcttgtggctgtgggagcgtcccattgtggtcgtggtagtgatggtcacggttgaggtagaaccgcagaagaaacaaacttcacttaccttcctgtcgccaaacgaaaagagaaaacctgcctcgctggagcttcccagtgtgacaggtgtcactttgccttaactgacagggtcaccacaggccttcccactccctaatggtgaggatcactcgaggcccatcccaaggccacgcttgcgtggctccgaggtctggggactgttagacgcagcctgctgcagccaatcctagcgcatttggggttacaccacaagaccatctctgaggctcaaccctgacacagccctaacaagcgccgtgtgctgtggacgcagtggctgtgttcctgcaggctggggcagggcggcggctctcggcctcttcgaggaatggggcgggagctgctttgtcagcacagtcccagtgctcatctctctgccagggcccagcagggactcgtggagattttctataaatctaaagtgcattctgagcaaacctgcctcttccctcatatataattgaaagctgaaactctcagcttattctcgattgtatatcaagcttgcgtcttagtcatctctgtgaatggtatttggaccccatgacagctcagtccctgtggtcctgtcttcatagtgaatgctgatttctgttcataaaaacagaaccatcaggcagcccctgaggcaggcaagccatgaagcttgaactacggagcccctttactgcaaagagagaggagttcgcctccctcttctcacatgaacctgggtggacagtggcctggctgttctagaaagcgtcttgccgggaagcatcaaacgccttaaatagccgttccctttgacccagtcatgaatctgctaaaatactgtcttgagaaaataatcagagatgtagatgacttccgtgttgtttctaagaacgaaaattgagattcacttaaatgtccacagagggtgaatagttaaaaagttatgaaatatttgatgagatattattggagctactgaaaagttaaacattaaaaatagtgtcctaaggaagcgctcatgacaacattccttaaaaagaaaaaatgcaaaatgcagaccaagaagccagatttacagaacaatcacagccgtgcttctcatacagacacagatgtgcatacgacggagaccagcagagcccgctcctaactagagattcgcaaatggcgccacccacgactgcactgaattgggcttcttttgtgcctcttctgcagtttctacactaagcacgaagcacctttagagtcgggggaaaagaatcaaagaaacaaaccccaggagatcattgaggctggtggattcagtcctagtcagaagcccctcaccaggcccacctgctgggctcaccgctgcttacctgcgggtggcatgagggtggcggcccctgcagacagagggaagtgccccttcccatcactaggaggcttctggttaggaaaggaaagcatacacaaatcctggaattggatgcaggaagcaggagccacccaaactctgagtgagccagagctgggaggtggctggacactgtgccaggggtgccaggccgtcctctagaactgcggcccagtctgttgaaaagtcaatggaatttagtctaatgttaacaagcttggtgtccttgatgcggtctcgtgcttaaggcagacaaggtcaggcgactaagaaacccacatggtctggtcttcgctcttgctgggatggcagtggctgtacatgttggtaatttcttggtgtgataacgagaggcttttcttgaagtccttgaaaaatgcctattctcagtcatctatcctatgatgaaagaggaatggcatagataatccaaaactcattgctcttaaacttaaaaatgaatttgacttttccccaaaggatttgctttcctttcctaagcatttttaagtacacagcagctgattgcaggaggaagttccccagaggcatgtggaaggccgtgtgtgtgtctgtctgtctgtctgtctgtctgtctctatgtgtgtgtgtgtatccctgtgtctgtctgtgtgatgtgtgtgtgtatctctgtatgtgtgtatgtgtatctcgtgtgtgtgtctgtgtgtttctgtgtgtctgtgtgtgtgtgtctatttgttccggtgtgtgcaagccccaagccagcgtctcctctccctttcttcagattagcagcccctcctccgcctgccctcatctcctccatttgcacatctgagaattcccgcccgcacggaggagctggagggtgtcagccttgtggtctggccctgccagcaggtcctgctgtgtggacactgcagaggagattagtccaaggggatccatgtaggagctgccatcacacaggaggttgatcaggaaacggttgctgaatgagtaaatgattgtcttcctctgcccctgccaagtatttgaaaacaaatgctcacttggttgtcgttgaaacaacaggctctgggtgtcatgatggaaaagagcgccgtgttgtggtcggcgtcgtctgtaactcctgatagcaactgcagtcttaggagtgtctttaacattagagaccttttccaaacttcagaagaggaagcaggacgtgttttctcttgtttaaaaaaaaaattgttttcctactttttctaggtggtattcataaaggtattcttttactgatttaattcatcatctaatgacatttgtgtaacgagctgcattaggaacttcttgttattagcctgcttcacatgtaaactaaaaatagctctaaggctaggattgaacctaaaaaagaacagaagaactgcaaacccgaaactgcttcaaggtatataagaaactaaaacagttaccaggtcacaaaataatgaccagtttacactgacatgcaactagcgattagcaggatgagcatccaaggacaccgtggtaaggacagcgtctgctaacgtttttattagttcaccgtcagatttcgtacaggtccgtatgactagaaagagccgtgttctgtctgcggctcacctttgattggtgaagcaacctcctttcttcccatgttggtttacggagctcgtgtctacattagaaaccacaaaagaatattaaaaatggtctgccgtgtgcttaagaaagaaaaagatgtattgaattgtgttctgattacaaaagtcatacaacttttttcttctctcagttggaaggtttcaaaaattgattctatccagagaatcaatccctacaaggctgtaggggcatgtgaactctcagacactgttggtgggtgggtccagtactccctttgcttagggcaattaagcagtaactgtcaggattagaaaagggtatacctgcaaagccagcaatcctgctaggaggcatatattcttaaaaaccactaatatacatgtccatgaaagggttctgcccggagatgttcatgataacatgatttgtaatgggaaaaagttgaaaagaatcacttagtaggagagttaatttaaaatgatggatccatgggttagaatactatacaaccattaaaattctttaagttgtatctttctatgaggacttggttggatgtccttgatccaaaaggtaaaataatcaaattgtacaaaatgcttgcacgagctctgtgcttctgtagactggaacaagcacgggaggaggcttggccagttacacagcaggctggccacacagtgacttctagaaggtggagttggagccaggcaaggggactgttctttttttcatcatttacttctggatgatttgaattttttagaaagaacagttattagttttgcaatttaaaacagactaaaataccatttttaattataaaaagctttaagagtcgatacgctgttgggaggcatcacacgcagaacccagtttatttcacacagcccttaaagctacagtggggatttccgtttggcggctccgcagagcatggggatcttgttttgccctgagagcatctgctcctctagggtggatgcggaagctgcactgcccgtcatcagatctgcggctgtgcagctggggtttcagtgcaccattagaaactcaggcagtgaaggagcgacttgagatggccatagtccccacgcagggttccctcccagcactggggttgccctgcctgcatggcttccggtcccgcttttctcactatgcagtgaacattgagcatcctgtcatagattctcccacaaaaatgactttttctgttttgttttgtttttctcctctgagaatgacactctgtgtgacattctttatataaacctgcagcaggcagagcctgagaagtcccctcgtgccaccctcagctcagttcatccttggctcatcctcggctcatcctcagctcatccctggctcatccccagctcatcctcagttcagttcagctcatcctcatccccagctcatccccagcgcatcctcaactcatccccagctcatcctcaactcatccccagctgctcctcagctcatccccagctcagctcatccccagctcatgcccagctcatccccagctcatgcccagctcatccccagctcatcctcagctcatccccagctcatcctcagctcagctcatccccagctcatcctcagctcatcccctgctcatccttagctcatcttcagctcatccccagctcagctcagctcatcctcagctcatcctcagctcatccccagctcatcctcagctcatccccagctcagctcagctcattctcagctcatccccagctcatcctcagctcatcctcatccccagctcatcctcagctcatccccagctcatccccagctcatccccagctcatccccagctcatcctcagctcatcttcagcttatccacttcagtctgctgtgggcttcacccgcctcaggaggacagctggctccaccccagctgcagcttctaaaatgggtgcttcctgttctttcctggaaagttcagaaggaaagcaaatggataggtcgattcccctccaggaagaccagaatagaataagtcgttggttttggatggaagctgcgtgaagaacacacttggtgggtggaagtgggagacgtagcttctctgactttgtttccactcagccaccaccagctggactctggtgctcgcagtctccgaggcagcaggacagcttcctcccacagctggggcagggaccgtgcagtgccattctgctcacctttctccacacttggctgtagtgccagcgcctgtctggtaaattactgctgagtgttaaacagtcaggggtcaggtttatcagccaagtcagacaggcttgttttagagaacactgtgattattcagtgttgtttaaattaaatacgtggttattctaaccgtgcattcttagagagtttcatcctggttttgcttggctgcacgtgcagagggtcctgtgggcagttccttcggcctcaagcgtatgggaaatattgctctggtaaaagccgcagcctggttccacctccgcctgcagacagctggaaagagcaccactcccaccttggaaataagaaaagggcagaaaagctataaaattctgacttttcctgaactcatcagagagctgaggtggcaggggaagtgagttgcccagcagggaagggaagaggtgcctccaaggagagccggaccatgagcaccagttccctgcagcagagcagaaggggccagcagggagaaatgctcacctgaaattggcagtggtttgcgcaaggctaaacctggaccaatggagaatctcaaacctttgggagccacaggctgcacaggccatggacgtccactgggccctcacccagaagattgaggtgggacacgagaagagcccctcagaggtgtgggcccgcagcaggctctcctgtgctgctccccacagaacataacctgcagctcctgatgaaagacagcaaaccctgtcgcccccagagcacaggcgaagacccactgccacagaagaactgcaaaagaaaaccttccatctccagcagggcgaggacctgccacgtgtggcacactgcagggagcaggacagagtcactgagaaggttccaccctgagacccagagacacaggccctgcctcagtcagagtctgggctagagcaacagagagcccttcggacccttccaacaggctagcaggctccaggcagcaggcacagcagtcgagctgtagcaggggcacaggagcatagagagagaagccccccaaggtgcagacacacgaggaaagccaaaaaccaagggagggtggggtgggaaccctggcaaaaaccctcccgaaacccaggccctgcttgaagcatgaggtagtgtgagaggaatccgaagctggccacatgctgagtgtcaccatggcaacagtaaaacccaagcccatttcagtgcctcgctagattgactgaactctttaacagtctagtaatagaggcacacccatttccaggcatgcatatatatatatatatatacaccttagtctctgctgttctacacatgaagtctggaattcattcagaaattaggagaggctgggcatggtggctcacacctgttatcccagcactttggaaggccaagacaagaggatcacttgagcccaggagttcaagactagccttggcaacgcagcaagacctcatgtctactaaaaagaacaaaggaaaagtatgagatgcccccaaaaatataagacaaacacgcctgccatcaagagacaaagcagagaaagacccaagggcaacccagatgttggaactatcagagatggagtggaaataaccaagattaatatgacctaaaggcattgacagcaaaggtagacaacaaacatgaacagatgagggatttcagcagagagttggacactaagaaagagtcaagtgaatgccccccagaggcctatctgtgacctcaaatagccaaggaaaaaaatcagtgaatttaaagacaggtctatagaaagtacccaaaatgaagcacaaagactacaaagagtgggaaaaaaacaaacaggattgcagatcatctgagagcttcaggacagtacaaagcagtccaacatctaaccacagatccagcaaagatcccaaatcatggtatatacagacacacacatgcacgtgcacacacacatatacacacacagctggacacatatctaagccaccacaaaccaaagataaagagaaaaccttgaagacctctggagcaaaaggacacattacttacaggggaacaaggacaagaatcaccacagacttctcattagaaactgtgtaagacagagatagtccagtaatatctttaaagtgctgaaagaaactgtcaacctagaattctgtacacacaaaaatatctttcccaaaagaaggtaacaagacaaacatatcctctcttgccacttgtcttcaacactgaactggaaattatagccagggaagttaggcgagcaaaagaaataaaacatatcatattggaaagaagaataaagccatctctgttcacagatgacatgatcctgaatattgaaaatcattcaaaatccattttaatagagtatcagaacttaaaaaccaatgcagcagtattgtacccacaagctcaatatccagtaaccatttgtatcagaatcccctacactagtaatgaaaaccctaaaaatgcaatcaagaaaacactttcatttataatcatagcaaaaataataaaatgcttaagaataaacctagtaaaagaaatgtaagacttgtactgaaacattattgaatgatactaaagaagacttaaataaagggaaagaaatcacacattcataggtcagaagactaacattaagttggcagaactccccaaatagctctacagattcagcaccatccctggcagccttttttgcaaaaattgacaagctgatactaaaatttgtatggcaatataagggacccagaataacaaaagaaaaatgtaagagacaaacatactgaacaactcacgcttcctgatttcaaaacttactacatagctgcactaattaagataccatggcattggcttaagagcagacatataggtcaatggatttgaattgagagcccagaaatataccttccgtcactgctttatgcctataaactctacaatttaggcgagatagacaaattccttggaagagattactacccagcgtcatttgatagcaaagagataacctgaatagttcctgtctattaaagaaaatgaagttttcttgctttgttttgtttgagatggggtctcattctgttgcccaggctggggttcagcggtgcaataccttccatcactactttatgtccataaaactctaaaatttagatgaaatagacaaattccttggaagagattactaccaaacgtcattcagtagcaaagagataacctgaatagttcctgtctattaaaggaaatgaagttttcttgctttgttttgtttcagatggggtctcattctgttgcccaggctggggttcagcggtgcaataccttccatcactactttatgtgcataaactctaaaatttagatgaaatagacaaattccttggaagagattactaccaaacgtcattcaatagcaaagagataacctgaatagttcctgtctattaaagaaaatgaagttttcttgttttgttttgtttgagatggggtctcattctgttgcccaggctggggttcagcggtgtgatcattgatctttgcaacctcaatctcctggactcgagagaccctcccacctcttcctccccaggagctgggactacaggcatgcaccaccagacacagcgaattttgaaattgtttacagagatggggactcgctatgttgctcagactggtctcaaacttctgggctcaagcagccacctcagcctctcaaagtgctgggattatggatgtgagccactgcatctagccaagaaaatgagtttttaactaaaaactcaacacagaaaacttctgacccagaaagtttcgctggcaactgtaccaaacctttaaggaggaaataataccacttctgcacaacctgtcacagaaaattaaaaggagtgaacacttcccaactcagtatatgaaggcagcatttttctgatatcaaaaccaaagatatcacaagaataaaaaacacagattcccaagtcctcagcatcgtattaacaagctccagccaggcacagtggctcatgcctgtaatccagcactttaggaggccaaggcaaggaggatcgcttgagtccaagagttcaagaccagcctgggcagcactgcaagaccctgtctcaaaaaaaaaaaaaaaggcattatacaaaaatcagttgtatttccatatgagcaattggacattgaaatttaacatcagtaccattcaaaatagcaccaaaatacatgaaatacttaagtataaatcttttttcaaaatatgtgaaagatatgtattctgaaaaatataaaacactgatgaaagaaatgaaaaggtctaagtaaatggagaccatgctcctggtttagaagactcaataatattaagattccagttctccctaaattgatacatagatcaatgcaaccccaatcaaaaccccaataggattttttttggtaaaaatagagaagtttattctaaaatttatggggaaaaggaaactaaaataaccagaacaattttgaactagaagaacaaagttagaagcctcacactatcttatttcaagacttgctataaaaaaagtaatcaagatggtgtgggattggtgaaaggttagatgcgtagatcaatggaacagaatagagagcccagaaattggtctacacaaatatgttcaattgattttcaacaaaggtgcaaaaacaattcaattcaatggagaaaggatactcttttcaaccattggtactggagcaattaacaaccagttgtcaaaaaaaataaaaagaagaacctcgatcagtacttcacaccttatacaacaattaactcagagtgaatcatagccctaagtgtgaaacctaaaactataaaacttctagaaggaaacagaaaaaaaaatatttctgaccttgtaggttaggcaatgtcttctttaataagatgcaaaaagtacaagtcaaaaaagaaaaaaacgataagttgggcttcatcaaaattaaaaactgctttttaaagacagttaagaaaatgaaaagacaagtcacagacagagcgaaaattataaaacacgtaagattaagatcttgtggctgttatacataaccctcaaaattccatgataaaggaaataagcagcccaattaaaaaacagtggcgaaagattttacagacaccccaccaaagaagatatacaggtggcaaataaggacatggaatgatgctcattgttaaggatcttaatcacgggaaagtacggacccctgcagtgagatcccactacacacctgttagaatgtctcgaatcttaaaatctaccaagtgttggcaagggacacggagcatctgaaaccctcattcttggctactgcaactacaagatgctacagacaccttggaaaaggttgtcagtttcttacaaagttaaacgtatgcctaccatgcaacctaaccattctactcctggatattcaccaagagaagtgaaaacatgttcattcagaaacctgtatgtgaatgtttatagtgactgtattcatagtcaccaaaaactggaaacaacccaagtttccttcacctcgtaaagagagaagctgatacaaccatacaatgaaagactcatcagaacaatatttaaataaactattgataaacgcagtggcacagatgcatctcaagtgtatcatgctaaatggaagaagctgctcaaaagactgtatcctgtatgatccatgtatacaacattccagggaaggcaaaactgtgtggaactgttctatatcttccacatttatcaaaactccgcctgtacctacagagggcgaaattcactgtacgtaagttacatcttcatcaacctcatgttgcggggagaagaaactcttttccctcttgtgctgaagtcacatgaaagatgatgtaaatgccttgttgaggagtgaacgtgcatagcaagctccgagcttcattcagagcttctcccccctccacagcttggcgatttgtggtaacacaaaggctgtgtccttggacgtaatgtacacgagacactggcagaatcaaatcacctctgttgcctgtggactcacgacgcacaccactacctcttccgcctcttcctctgctgcctctgtccacggaggggactttattgttcagtggggaggggatagtttgttgctaaaccgtggggaaaataataaaaagcgtcaaggggaaaagcacatcacagaggcaaatttgccctcacttcaggtcatcaggagctaagcgggtggagagggagggagctggcagtgtgagcgtttaatgtgttagcgatcttttcccatgggtgcctctccccttttgccttcacccaagtctttctcaatcttgatagtcatgtacctgttttgaattttatcccctgcaccttgaacctttctaaattcagagggattgaagataagactcagctctaaggctcccagattccccggataagaatttatcccaaaactgccccaaactgctgctttcccgtaagtcttctggggaacctctaatctccctttattcctgagccccaggtttttctttgcaacaggaaaggagttgtgtttcattggctttcagctgaagcctctgtgggaggcttcagaatcgtaattggtttctgtctgagtggaagccaagaggtacaggagtgtcaagatcctcatcatgtaacaggatcagcggcacccacagcctccaggagctctgtttacagggaggctcagcctgcactgggcctgggcccttttttactgaaaagcctttattcagcctgaagagaaacaggtggagaggaggcgacagagccgatgatgaagagctgcggtgtcatttgctgcctccgtgctgagcggcggtcacatcctagtttcccagggtgggtgcccgcatcttccacggcatctctgccttcccctggcctctccatccaccgctctccctcctgcctcacgccgcacctccacttctgcccatgcttgtcctgtgaccctcgtggtcatagctggttgtcctgacacagacacttggggtggttccggaaccgcgtcccgttcagaaagtctcttcccagcccagcaagggctgtaaaggaaggctgtgggctctctcctagagctcagattagggaagtggcggcccctacccctacaggcagaagcccctgggccgggagagggcccttgcagtgccgtggcaacaggacaagtgtggggccccctgaaacccctcagctcctgtctccgggcgtcctgtgcccctccctgttctggcatgggccccctctcaaccttgcagtcgtctttgttgtctttggagctgaggctctgaagccgccccatttctaccccccacgtctggattctttgcctgagctcaggcccaggaccatagagtgccgggccaaggagctggaattcccatcagttcctctcccttcccactcgaaagttccttctagactcttcctctaatttattcccagagaagcccgagtctcattaaagtgcaatgtctctgttcctgcacagctttgagtctttccaccgcgggttttttcttattactgttctatgttatttaccatttgtcatttcttttctaataagctcaggattgtcgtcaagtgaaactggttgctaagaatccacagtctatcccatttgccgttgcgggattatttctaaatcagaaaatgtgcggagggagccatttgacaccttttgtggttactgtttccgggtttggatgtcttttttgctgtgttgttgctgttttatcgagtgtggttttgtgacttttaagaagaaaaagaaggaagcagagcaatcaaatgctaggaactgagccacagccacccatgagcacggggtcagacatgaggtttggggcttgcctgtttctgttttgtaatcagagctgacacaaagcattcgaggaagagacacaaagaatgctctgtaagcatttgcacatgataaccacctacaacgaccgcctaaaactccacacggagaaaccgttttctttctccgccacatttacgtgcaaggacgcaaacacggccatgcgccatagtctttattcccatttcttctatcagagaaagcgactttttaataactaatgcaggctctctttttcctttgtcgagacagagttgcttttagccaaaaggaattagggttcttaccttgtttatttcatttattttatattttgggtcttcacaagtcttagtttcttagcaaggaacagaattagccagattgactggacggcatgtatgcttaaggaaatgcatctgcgtaacccagacaagtggccatcctcccgcggaaagtcaattaaatcctagttagtatttgccaagtgtggacctctcctagacgctgaacgtgcacaccccaacccacatgtgcgtgcacacacacagacacatgcacgcactcgcacacacgcacacacacgcatgcacgcaaaggccctgaagtgaatgaagacctttgctcagggaagagagggcagcagcatgtctagcgtctgcatatttcaagtgaaaataaacttggtctttctgaagctgtctcattagggaaggcactgaagttctcacgagttagtttaaccccagccaggcttgcagctcagcaccctcctagctcttccaccatcaggagcccagtggcaccccctctgctgcccaggaaggtcccacactctctcggggcccggcctggcctctcatgaggctgtcttccttctgtctcgtaagctccctcatcttccagccagctgcctggttccctttggcattagagagagaataaaggcagtgtctcctcaagcgcacctgcctcctgattgtgttttcagtgtttgaagcggcattcggtgcccccctgccctgctgctcagtgctgacctcagtgccccccattccctggggaggcgtttcccaaggccctggtccccatcatacacctgtcagcctcacaggccactcactcaagggtctcagagcccccacactagtgaacacaggcgtggagagcgcctctcccagctccggggagggaccagcgatgtgttttgtagcagacacaggacccacaacagcccgtgcctctggtgcactggccagacgagaagcccaaagccttcagcctttgagaaagaggtgccttcatctgaaaataactacagccaaccctccatgtccacaggtgctgcatccgcagattcaaccaattttggataaaaaaacaaatgtaaataacaaaaataaatttaaaataacaatacaacaagaaacaatccaaattttaaaaatacggcatagcagctatttacacagcgttgacactgtgtcgggtatggcgggcaagctagcgagggtttgaggtgtgccggaggatgtgttctgcttgtacgcagatgccacaccctttcgtattggggactgagccgcgcaggttttgctatccgaggggtcctagaacccataccccattgataccaagagacaaccctgtttcatcgctgggcttaactgggtgttttctgttgttgaagatcccagaagagcacgacctggagagtcagatccgcaaggagcgggagtggcggttcctgcgaaacagccgtgtcaggaggcaggcccagcaagtcattcagaagggtaagggcacccgcacagccagccaggggctcattccgggggtggggcctggggcgagggtcccctgtgagcaggccccccgcggcccacgcacaaccttctccagccatccactgtcccacgacagacccgccccgcaccccacctcccttgcagataagcacatcaaggctggtggagatgaagctgctgctcctcaaggttctgcagcccagagtggggaggggaggggccgggtgggaacccagccaccgcctgggaagagggctctcccgggaccctgcctcttcctctgcaagggcagccctcagccctcgggattatcagcgcaggtggaactcatggaggcggaactttgcatgttgacatttccggaagggaaggcctctgagagcccacatctccccacccggacaggtgtcgttgcgccaggccctacacatggcgcatccttccctggaaacaggaagtgaaaatgccaggccctgctttcctcagctggcctccacttgtccctgaaatggtggccagctctgtcaccccacatctcagtcatgattttcctaaaccttctcccagatttgccactagatgccaaatcgctcccttcacctaccttgttgtttgctctcccagctgcacccggggtggaggggcagggagcagccctggagggggcggtgtctgttgccgcagacagcggagggagctccttgcggaagggatccaggctgcaggcggccccggtcacagagactgtgtggggagcagggaggccctgagagtcaacacagcaatgagggtgtcaggcagccccatcccagggaccctggcctctccccaggatccaggagagtacaggggcccaggcccagccctacagccccactgagggcacggagcagcagtggtgtctccgcactcctccccctgccctcgcggccacaggctcccaccactgagccagctctggctgggggacctcaagctgcccccaaccaaatcagcaccatcaaaagtcaaggactctgaccccagtctgcaggtttattgttttgaccttgcatctttgtcctgtaaaattctggagattattatgggttactttctgaagttgaggttgatgacccgtaggacagatgtcctccctcctgccaaagccgagggccctgcccgcaggcagcacaggcgccatgagcgcgtcctcagcgagcgtgcctaggcccggctcacacctctgctctgctgatcaccgaaaacactgctgacttctggtaccagcaacgtttctgaagcgcattcccacgcagctctctctgtgaaagactgcggttcatctcgcattaacgcagacggtggctgttgtgctgaaagctaattgtggttgtttgtagccctctgtgcatctgaagagctggcggcagaccaggtttaaagcatcgcatgttgcaatccggtgcgtgctgccccggcggccgccgctgaaccttgcagccagggtggctttctccagcagagagaacagaccctgctggatgagcgtctccaggtggcggcgacaggaggctgttttcctggaggttagcgattctctaggaccccagcctgctagctgggatggccagcacacgggggctgcctgctgcctgagacaggcttgggagctgagtctgcctcacacagttcaacatctgaagatgagctggcccctgatggccaaggtgatgctctggcctggagcctgtggtcagaattgagcagggtgcgaaacagagccggcattcgagacccaaaaccgagatttctagaccaaaaaaaagaatatatttgtaaaccagagtttgtccagacacacaaaggaggagctgctgagccgctggagacaccaccaaatgaggcctcaagacacaggggatggtgccagcaggcgtggtgccagcaggcgtagtgccgggagtcactgaggagtgaggccgcgccctcctcccagtcctctgtcctcggaattcggattcggtgcaggcgtttattttcatttaaggagccaactgtgtgctgggaaagatgtgagcattgagaaaaaggaggaattgatgcctgtagatggaagagaaccagagaagtcggcgtcgcccaggagacggggttgggaaagccctgtgtcacgcaggcccctgcccggctcttcagccttctcctgggcaacattcacgaccttggctgtcacgcactgattttcaaacgtaccaaatgcgtgggctgggtggggtttccctttgtccttcagtgcttagaattatgcccaaactccgtccagaactccctgcagctgggaatggaggcaccactagggtaacacggtgctgccgccgcaccaaagccttcgggcctgcctgcctctgtgagtgcagcctctccttgtataacgtggcattcatttcctttccgtggttctgggtgtttgctggggactgacattgttggaaacagtagctcacccgaggtgccgagcacacaccaggcatcagtgaggcttcagcccgcagactccgtggccctggtgccacctggacagtgccaggcacaagcggaggggctgtcagctgctggaggtgggcggctttggctgtgcttaagcccagttcagagcagcctgcagcagagtgcccaagtcgcgcggctttgaccttgcaccccgacggtaggctccttctgttgtaggactttttaattcagctaaaaacagggtctttgtcacatgaccatgaaaaattaggctcccagacactttgaagggtgggaagggcagggtttattgggtgagaaggaaaaaacgggaaacagggcctccccgcaaagccggagtcctgctggtgcacttcccgcctcgcagattggatcccaggttctaccccagatcgggaggctgggctcctcctgctgcaaagggcgccaacttctgtggctccccccgttgtcccagtgtgcaggctggtgggagtttctctggggacccctttatacttggctatctcacttcctgccagagcacaagcccaccactccccacagggaagactggaggcgggcaacggtcctctgagccagaccagaagttcaggtgaggacacggttagtaagagccagtcaggtgaggacacggttagtaagagccagtcaggtgaggacacggttagtaagagccagtcaggtgaggacacggttagtaagagccaggcggtgtctctctgcaccacctggagctatgtctctggctgaggaaggcttgggggtccccaagacaccctcctggttgcccagaggccacacaggtgaccgcagccaaggccaggaggcagcccagcttgtgtccttggtgccacaacagacaatgaggcttatgcacccacagatccccagctgccctttcagtcaccaggatgtgttggaatccatcttgcgccctctgcatttttagcttccttttatggttccttctagaaaaaagccttttagagtcacaagggacttacttcctagtgctcgtgtttgggggcctggtggttaagtccacgttcccctcttctgttaaatctgtgattctgtaatagatccctcagtcaaggaagttcatagttaccattctagactgaaagacccccggactttggctgcaatgtggatcctggcgaccacacccatgtctcctccttaagtctgttacgaatcagagccctaccgagcttattctgaaactttagcactttcttcatataatctgacccagataaatttgtacaaacctgaccactgctgacaagtattggctgaatgcttccacatgtccagctcggcatcaggagctttgggggttttgagcaaaggcattaaccctgcggccagggcccctgggccctcattctgggtactcagtggctgccgtcaccccaagagcccagatgtgcctgctcctcagcaggtggtcaggcccctcccttcagtccctgcttttcttctgcttcctttgtgcctctccaagtccccaaggtattgacgtcggccatgataagatacgtcgtgaatatttattgtaaattaagactggcttgccgggcatggtggctcacttctgtaatcccagcactttgagaagccaaggtggatggatcacttgaggtcaggagtttgagaccagcctggccaacatggtgaaaccccgtctctactaaaaatacaaaaattagctgggcgtggtggcggatgcctgtaatcccagcgactcaggaggctgaggcaggagaatcgcttgaacccaggaggcagaggtggcagtgagccaagatcacaccactgcacttcagcctgggtgacagagcaagactccatctcaaaaaaaaaaaaaaaaaagactggctactggctgggcgtatgcccataatcccaacacttgaggaggccgaggcgggaggatcgctcgagcccaggaatttgagactaccccgggcaacacagtaagaccctgtctcaacaaaaaacaaaaaaaagtagccaggtgtggcggtgcgcgcctatgtccccagctacatgcagagttgaggcgggaggatcacttgagcaggaggtggaagctgcagtgagccatgatcacaccactctgcaccccagccagggcgacagaacaggacactgtctttaaaaaataaaaaaggggcccggcgcggtggctcacgcctgtaatcccagcactttgggaggccgaggcgggcagatcacaaggtcaggagatcaagaccatcctgtctaacacggtgaaaccccatctctactaaaaatacaaaaaattagctgggcatggtggcgggcacctgtagtcccagctactcaggaggctgaggcaggagaatggtgtgaacctgggaggcggagcttgcagtgagccaagattgcaccactgcactccagcctgggcgacagagcgagactccgtctcaaaaaaaataaataaataaataagggggaaaagatgctggctcctggatccactcttgtgtgtttcttttgacaggcattacgagattggacgaccaaatatttctgaacaggaaccccggcgtcccctctgtggtgaaattccaccccttcacgccgtgcatcgccgtagccgacaaggacagcatctggtatgcaccgcgctggtcaggcctcccttccggctgaccgacagccccagcgatgccctgttctcccccgatcaccactcctcttccttgaaaagcagatacaaggcactcaccccgaggcccttagcactgtttcctgagaaacggccctactcaccttctcctctttgaccgagccccacccacacctgccccgggcctggccctgtccttgtcactgaaggacagtccagagtcctgcctgcaggtcagaggggagtggcagggactccccagtgacacttgtaatagaggcgtacacaggggggccagcttgctgccctgcccgcagaagcaagcatgtgatagacaagcagtaagaagatgctaggtgccccaggagagaagtgagtttaactcacagcaaatatcgcccttagagatggagagagtacccacttcatgggggagggcagtgggagggggttccttttagagtttagagtttataaaatctctgtggttcacacctccatttctttttcctctttttaaaaattgtggtaaaacatacatagcctaaaatttgccattttaaccgttctgagtgcgcagccagtggcattcagcgtattcacattgttatgcaaccatcacccccattggtctccagaaccttctcatcacacaaaaccaaaacttggtccccatcagacaccagctccccattcctgcatccgcctgagccagtgtttcactttctgtctctctgaagtggcgcacgctaggagcctcataccagtggagtcacccgggatttggccctttgtgcctggcttattcggctcagcgcagtgtctttaaggttcctccaagctacagcacgtcagaatttccttttcatggctgagtaatattccactgtgtggatggaccacactttgtcttatcattcatctgttcatggacacctgggttgcctccaccttttgtctattgtgaataacactgctgtgaacattggtgtacaagtatctgttcaagttcctgctttctgttttttggggatacgcccagagtggaattgctggaccatatggtgatgctctgtttaattttcggaggaaccaccaggctgttttctgcaggaaatcctcttcccttcccacccgcacagcctgtggctccaatttcccacatccttgccagcactattattctctctttgtttgtttgtttggagacaaggtctcactttgttgtccaggctggtcttgaactcccaggctccaacagtcctcctgcttcagcctcccaagtagctaggatgacaggtgtgagccgccgtgcccggctgtggtgtgtggttttttgatagcagcccggtgggtttcaggaggtatctcactgtcatttgggtttgcagtttcctaatgacttttttattcctctcttcttcccttaagcttttgggactgggagaaaggggagaagctggattatttccacaatgggaaccctcggtacacgagggtcactgccatggagtatctgaacggccaggactgctcgcttctgctgacggccacaggtgagcggggtttgcacagccaggattggaagccagggtctggaggagtggcggggagggtgtgtgatcctgagatgtgtttgtacatctgtcttacagaaagccctgctcacacgcgagggccactgtcattcagaagtggggaggtttatgagggaaagggcttcagcagcagagacaggaaagcaaagatgaccccatccttgagggttccagggacttgtcttctcatctcagtcctctagcccttccagcaccaggaaaagcctctgacagcctctgtccttaaacccctgtgagagacccggtgggtcccacgtgacacccgagaatcagggaaggatgccccaagccacaacacgtgccaggtcctccccggccagggtctcctggcatcgctggctcatttgccagttgctgtccccactgggagctggcactcaccctcctccagtcccgtcctgcacctgaaaggacatcgttgaccatcatggtcgctgaccagtggttcattgccgtagtgggtctcactcaggttttggttttcttgggttttcggggggttttttggaggggtccgaaatgtcttagtttcatcttcactttggaacaatcgtttgtttccatgtcagttaccccacgttgacagtcattttcctttagcgctttgaaaacacgtgtccattgcctgttgctgatgagaagtcgctgtcagtcccactgcacttcctgtggagactagagagcgctgggcgggaggcaggcgggggaggccagcacggctgagagaagtgaaggccgacacccggatcccacccagcctgtccctgtcggccgcagcccctggacacctgagcctctgagagtgtcgagtcggttgtgctgacaagtgcgcagccctctcaacgcggttgcgggctcctggtgaggggcgtggccatggggacgtgtcctcgtgcagcccctcctccgagcgctgccccctcaggaccaagtagcatcaaccgatgtcgaaagcccgtctttgtccctgtagctgtcagacgtgaccgggaggagatgcatagtcggggcaggggccggtgggggcaagggaccagccaggctcagccagcggtttcggagagaccagatgtgagcatctcccaacaccagagggagagggcagttccttggctgagagagcgagcactggagcagggccagggtcctttgcagaacgggctccagacagcagtagaagggctccagctccaaaaccaggaacgtttggtgtatgcgatggaaagcagagagcgggacaggcaggtgggtggaggtgaggccgtcgtccaccagggcaatcagctggggcttgaagagcgcctgagggtcacgcaggaggggctggtgaggccagggggtgcggatgtggttcccggaaggctcagagtgcccgcatgctttccccacacccaggccgacctccctgcctgtctgctggaggatgcagagggccgtttcctccattctaagccctgaagagcagggcagtgcgtccctgcccacgtcttaggcggagagcccagacgtctgcattgtcccttcaagtcaaggctactctctctgtggagcacagagaggaatggggcggagggtgctggtgtcctctgtgaagctggcctttcgttctgctccctggcacaggctggctcaccagagggtaaaacgcagccccacccacccaaccgagcttcacccgcctgcctccctccagggaacccgatgccctggagctggagggaggaagggcagccccggctcccagggcagccaaacctcagagttgagctctgtggccagggtgggacaggattgtggtctcccatcccctgggctgcgactcctcctgctggctcgcccagatatggatctgaggacagagtccagtcggtgggcacccagagatctggaaccacgggtagtgagtcaggctggccgcccagggtcactgcagcacgtctgccaggaagggctcttaccaccacgcacagagcacaggccaggccatcgaggggcctggttcacatcctttcctctctccctccccagacgatggtgccatcagggtctggaagaattttgctgatttggaaaagaacccagagatggtgaccgcgtggcaggggctctcggacatgctgccaacgacgcgaggtgggtccgcccggctcctccccagagcagaatgtgttcccggggctgcggacgcactcggaattccaaggcccttctggggctgtctctaaacaggctgctccacctcagagtccccagaatcctaaagcaacagctccccgccaatgtccccgaaagcgtgagagccccaggtccctgagtgcactgcctggctggagtcccagccctgggcatggtctcagccactcgtgggtgcccctgtccccaaccttcatccttggcttgcagacatgtgctgcttgggacagcatcactgctggcagggcctaaagggcccgcatcacggggtccttctttggacctaaaattaggtctgctctttggacctaaatttaactcctccttgggggtcggggtgcacatggccatctggggcctcacgcgctcgctggcatgcctgggctggtgggacggagtggctgcagtgccggctctgggtacagttctgcgtgttgcctgcaccgctgcacggcctgggtgcggggcgaggcgcaggcccacaggtccttctggaaggactcaggcaggagttaggaggctcccggggtcaggcttctgggtctagatttccagaggcccctctgcagcaccaggcattcgcctctaggagtcatcgctcttcagcggatcctgcagcccttggcgatgctcagagtgaacgcgttaccccgccagcccccctctgccggctcctgccggtttgtgatttctgtgtcttcgtctgtggcctgtggatgtggccttacacctcgtggtcagccttccgtgtggggcctgccctggttctgccctaggttgcatggctctgtctccgcccttctgtctgagcacctgtcccgggagatgccaaccctcacgtgcctcgggacgtcatgggggcagctccagggtggacattgcctcgaacgttggatttttttttttaatgtagccatgttcttaagtttcatccagcaaaaaaaatcatccacaccccgcactccgtgggggccctttcctgttgcttctgtcctgatctctgggctctgcttcccctgcgaggcaaccctcttctggggtatgacagcttccctgggacagggcaggaaaagtgagccccagcccggggccctggtccaggaggggtcccgggagacagctggatggccagcctgggggtcaggccactcaccggccattgtgtgtctctccaaaagaccaattttggtgacactgtgtcatttgctagagaggaaagatcactgtttgataggctttccaggctgtttttctggggtcgctcagaggcagtggtgccatggaaggagctgggcttcagcacgggagcgcctggctgagccctggctctgccttgccctttctcttgtttgcttttgtgaaaacttccctccctgtccaaggctcggacctgccggaaatgcagtgctggaaggacacacccgtggctagccccggggtccatgagacccccctagaagcatccacatgtccatgcccagctggccccggggtccctgagaccccccggaagcatccacacgtccacacccggctggccccagggtccctgagaccccccagaagcatccacacgtccacacccggctgggcctggggtccctgacacccccagaagcatccacacatccacaccgggccacgctgcaggaaacaagacttggtggcctgtgctgccccacgggctctcagtctctccgggtcaggatggcagtgcccagcttacatatcaggaagcagcactgacgagaaaagcggccttctcggcccagaccctccagtgcttccttcagagtgggagcctgtgctgcacttcaggggtctcggggtcagagaacgaggctctcactgcgggggaaggcagcagaggcgtctcgccagacgtaagagctccaggccccagtccccgaaggctgtgccagctgtgggctggggcaccaggcacagctctgggctccctcaggttgcacaggacatgggaaacctgggtgtgggcagcaggcgggtgtgtcactgctgctgcggctttgctatgtgtccaggactggttcaaaccagttcactcggcatcacagaatctgaactgaaaaaggacttagggttcacctgactatacccctccatggcaggacgctcgggccgagggacagctgcccagagcctctggttcagatggacacctgaggcccagggtcgggctgtgccatgtcccccatgccggcatgtcactgtcctacccgggtacgtcggcctatgtgctggagacagggcctttacagaggtgattaaggtcaaaccaagtcaccagggtggccctaacccaatgtgcctcgtgtccttacaagaagaggccaccaggacacagacacacgtgcagggacaggtgggcgttcctgggacgccggctcggcactcacccaatgaggtcacggtgtcaagggagggcccgagttccagcaggttgctgggggatgtctcacgggcctgagggtaattatttgtcatcgattggagtcacactgcctaaatccagagccgtgaatgctgaccacagcacagccaccactcttcttgaaagtcacagtcaccaggacccagtgttggcatttgatagattaatggtattagcaggttggtttccctccgcggtattacatttaagggaataaacaactcacatgaacggccaagggctgaagacagaagtggtgctctccatcttcgtcaggtgctcacggagggcccacagcacatctgatctggtcaccacggggatccgtggagccgcagaggtttcatcctcccctggaactgaggagctcaggccctccgccagcttctgctgcagggagcctgcaggaggcccaaggcgtgacctccgcttgccccagcccccactcgcctctcccggacccgcttgcccagttgggcacacccagctcaggcacacgcaagccaggctccccacgtcacccctgagactggtgctttggaggctgtttcttgttttctggcatcttgaatgttctccatgtgctcgttctcaccttttccctctgtttgttctgctcgtgtcactgctgttcccagggcacctctctgttcttcccgacccaaggtgtcgcttcctggcagagtcaccaggaggatcgtgcctgggacgtggctgctgccccccaagtgaccatgcagtctagaagtgcagagcccagacccatgcatctctcccttctctttttcttttcttctttttttttttttttttttttttttttgaggtggagtctcgctctgttgcccaggctggagtgcagtggcgtgatcttggctcactgcaacctccgcctcccaggttcaagcgattctcctgcctcagcctcccaagtagctgggactagagggtcgcaccaccacgcctggctaatttttgtatttttagtagagatggggtttcaccatgttggccaggatggtctcgatctcctgacctcaggtgatcctcccaccttggcctcccacagtgctgggattacaggtgtgagccactgcacccagcctgtgcattttccaagttgtgcagccaccacctttatctagttccagaagattctcaccactccagaaggcggcctgctgcccattaaagcagtttcttcccatagattcttatttatctatttttgagacaggttcttgctgtcacccaggctggaatgcagtggcaccatcacggctcactgcagcctcgacctctcagggctcaggcagtcctcctacctcagcctcctgagtagctgggaccacaggcccatgccccacacccagctcccataagttcctcacttaaacagagagaaacttagaaaatgtctgtgccaagccaagccctctgtgcttgtggatctgccccaggtctcagagtggggcctcagggcctcctggcgcagcctccggatggccgtgcctccaggcaggacagcactgagccactaaaagggatgcaccaggaaccctgggcggtgtcctcctcggtcacccagacgccacttcccaagagcatgtccgggtgggcagcaagcattctttgtgattaatgtaggtaacagcatatcctgagggagggggctccagttctgtgtcctcaggctctgttggctgcacagctgcagcaggagctgggctcttctgggcagaaacggggaagtatgtgccctcccgcccggttgcacaccggccctcactgtgctcacaaggcctcccagcggaggagcagggctgcaagttgaaagcctgtgatccaccacggcgctcgtgcttctgacctgctgggacatttcttcctgcctgggttcaggtgtatcacagtagagggactacacttctttttttgtttgtttgtgtttgtttttgagatggggtcttgctctcactgcagcctcaaccacctgggctcaagcggtcatcccacctcagcctcccaactagctggaccacaggcgcacaccactgcaacggctaatcttttttcttttgagacggagtttcactcttgttgcccaggctggcgtacaatggcggatcttggctcactgcaacctccacctctcaggttcaagcaattctcctgcctcagcctcccaagtagttgggattacaggcacccactgccacacccagctattttgtgtatttttagtagagacggtgtttcactatgttggccaggctggtctcgaactcctgacctcaggtgatccacccgcctcagcctcccaaagtgctgggattacaggcgtgagccactgtgcccgggctacattggctaatcttttattatttgtaaagacaaggtcttgctatgttgcccaggctggtcttgaactcctgggcttaagcaatcctctgtctcggcctcccaaagtgctgggatcacaggtgtaaacacatctggcctgggactgcatttcaaaagtaaaataaagaatgtatgtatgccagcaattaacaactagaaaatgtaattataaaacatcatgggccaggcgtggtggctcacgcctgtaatcccagaagccgaggcagatggatcacctgaggtcaatagttcaagaccagcctgaccaacatggtgaaaccccatctctactaaaaatacaaaaattagctggacatggtggcaggtgcctgtaatcccagttactcaggaggctgaggcaggagaatcacttgaacctgggaggcggaggttgcagtgagccaagatcacaccactgcactccagcctgggcaaaagtgtgagactacatctcaaaaaaaaagaaagaaagaaagaaagaaatcatagacaacgggaataaaaactgcaagatacctaggaatgaatccaacaaatgcactttcttcacagatcaaagcataaactctaattgaagactataaaaggcacatgcagtgttcatggcaccatagccatggatgaaaagactcatcattgtggagattggcagttctcaaattaatctgtggatttattaatacacttttgattatattcccaggagagatttttataaaatgcagaccagccaaggcaatattgaagaggcgcagacggcattaagaagctgcaattgcagggcagccaggccaagaggcaccagggccctcagcgcagcagtgagcccagaagggccgcaagtggcagggtacctctgcgcactagggaaggagccatgttgctaaatggtgttgggacagctgatgccatatagaaaaggatgcagtgatacccctacctcacaccatgcacaaaacacatcacagtgagagacctaacctgtaaaagcctttcagagaaaaatcaagaggaaatcttcctaacagtgaggaacaaaaagacagattgaacaagagattgagggtaaagacatcaataggtttgactctacagacttcttcatgaccacaagaaaaatgtcacggttgtaatgtaagtggcagaataagaaaagatatttgcagtatctacgagttacagaatatatataaaaatatgtgcaactgtctgtcgtgaaaaaaaacggcaaacaccacacatcgataaggatttggggacattggcttgtgtgtgtcctgccgagagtgtagatggtcacccatttggggaatgaaatggccttccctggggagatcagagtcatgcaggatacatgactggcagttccgttctaggcgcttccttctccacccgcaaggacacgtgaagttgttgactgtgacatggttcacaaagccaggggcagctcaaatgacggggttagttgtacagtggaaggtaacgcaagattaaatgagttaaccagagctgtgtgtcttgggccagataaatcctcaaagcctaacattaaagaagcaagttgctagaaaataggccccattttgacactgaagaggttttttgaaatgtggaaggcatgttacgttgttgatgagcgtgcgtaagcaggaaaacctcagcagcccctgggaggcgccctcagcccaagggacagccctcccaggcaggcgcaggggcagacgatgcttttactgtgtctaaaattatgcttctctatgaaaaaaaaaaaaaagagcaaacaatggtaaaatgttagcaaagttagagctgagtggtgggtacaaggattactatggtgttcctttctgtatcttaaaatggttatcattacagttttagaactgaatctggttttaaatacaggccgtcacgtgaggtgggggttgctctgctctgtctaatccccacacaaagggcagcccttgccccattctctccgtccatcccttgctgacgccagccgtcgggagtcagccccttgctgtctgaaggctgccggcccgtggcccatgccgagctcctgtttgtctcagaagaaccggcttcctcaagctttgatagggccaaaaggaggaccctcatcttcaagccttaacagccttcctaaagtcacccagacctgccagttctgcccaggcgtccagacggcaggcatcttagacgtcgctgcaagggtctgctccagatggtgagcaccttagacagacgttgctggaaggcactgctctgaacggtgggcacctaacagacgttccgggaaggcactgctccggatgttgggcatcttagatgttcctggaaggcactgctctggacagtggacaccttagacagatgttcctggaaggctctgctccgatgttcctggaaggctctgctccgaacagtgggcaccttagacagacgttcctggaaggctctgctccgaacagtggacaccttagacagatgttcctggaaggctctgctccctctagcgatgcctggggcatagtcgagtcaggggaagactcagagttccagctcagaattgtcgccccagcctggacttgggagttccagctcagaattgtcaccccggcctggacttgggagttccagcttagaactgtcaccccggcctggacttgggagttccagcttagaattgtcaccccggcctggacttgggagttccagcttagaactgtcaccccggcctggacttgggagttccagcttagaattgtcaccccggcctggacttgggagttccagcttagaactgtcaccccggcctggacttgggagttccagcttagaattgtcaccccggcctggacttgggagttccagcttagaactgtcaccccagcctggacttgggagttccagctcagaattgtcatcccggcccggacttgggagttccagctcagaattgtcaccccagcctggacgtggggcacaccagggtccctagcgggagctcatatgaggcatatggacccaccagatgggctcgatggtggcaggggtaccttgtagctgctggccaaattgctgcccagagcaggccccaaagcctgcccaaggcaagggcccatggggtgatgccatgtcccactgtatctctccaggagctgggatggtggtggactgggagcaggagaccggcctcctcatgagctcaggagacgtgcggatcgtccggatctgggacacagaccgtgagatgaaggtgcaggtaaccatgcaggtgtcccccaagccctgggcctgtggggcagtgtgtgcagggctggtcctcgtcacagaacccagcaaagtgtgcggtgaggcctggccatcccaggggtggagtcagggcctgggaggacagtgccgggacaatgctgggaggagacgtgggctccctgaggcctctggatgaaggtgaactgcaacacccagccctgcgctgcagtatggctcaggctgcgccagctctgagtgtttgcaagtagtgtcttctctctgcaaattaaggaatgtcagaaatcagtagggtgaccaattgtaaattagaatgattaattatttggaggcgtttttttttttcttttgagatggggtctcactctgtcaccctgcgtcacccaggctggagtgcagtcgtgcaatcacagctcactgcagcctcaacctcctggtccaagtgatcctcccacctcaccccccccccccaccaccaagtagctgggactacaggcatgcacccacacgcctggctaatttttttaactttttgtagaaacaggggtctcagtatttgcccaagctggtctcgaattcctggctccggcaatcttcctgccttggcctcccaaagcactgggattataggtgtgagccgctacagaagacagaagatttttgtttctttttttttttttttttttttttgagacagagtcttgccttgtcgcccaggctggagtgcagtggcgcgatctcggctcactgcaagctccgcctcctgggttcatgccattcttctgcctcagcctcccgagtagctgggactacaagcgcccaccaccacgcccagctaattttttttttgtatttttagtggagacggcgtttcacgtgttagccagaatggtctctatctcctgacctcgtgatccgcccacctcagcctcccaaagtgctgggattacaggcgtgagccactgcgcccggccagaagcctctttgcttcttaaagcatctgctattttcagttttgacaaaaagcggagtacattggttttgcccaagacagcctggaaaagtggtagagacctaagcaggccgcgctcagcagaaatctaactgcattgacttcatttggagcagaggcgagaccacagatactgtgaggggcagcgcctgaggtggctttagagccagtattcccttcctctgggtccccagggagaggtgtggcacagaggccatacccagcctctctcccgggcaggccatctggtgtcaggagggatggctcagccctgctgccgtagagggcggtgtggagcaggcccagcagaggggaggcctgggcaccctcagctgctcgaagctgctgtggttgctctgggcagcagcagcccgagaacctggcccaggccttcccgtgtgggcagcctcccctctgacgtgaccgtggatccctcgaggcaccagcagctttcatggcaccttctttggggtgggggggtcttgcacctgtctggagctgtggctccacacgagacgtagccctcagggcacagcgtggacaccctgatcctcagggtctggtcaccagtgggggcttagaggcccaggtggcctgcggggcaggtgctgttcctgcagaggtgggtggaggcacagagcgcagcaggtgctcccagagccggctctgcccctcgcaggggtctggccccatcatccccacgcctgtgtttcctcctggagtgcacaacccagcaccgcccatcgtgcgtggaaagcgctctccctctcgtggcccttttcctcctgcgtccctggcaggtgccatcgcccccgcccccgcttctccagcacttagagcccccgagggagccagatgacccctcctggactcatcccatagctcattagaagttctgagacgcagccagtgaggagtccttgccaaaatgtgctttgctttcctttttaggaaacagagagaggttggaagtttaattggcactgacagccagtccttcccagaggcgtttgcaggcctccgctcggggtggggctggcctctgcctcactggctgggtcccaggcgcctcagggcctcagggctgtccctccagggccaagggataagggcgtgactcattgtcctgccagcccctgcctctccctgggactcctgggctccccaggcctttgatgcttccctggatagagagaaaggcccctgcagccagggagggtgatccccacagccaggcaggcagcaagaggggtcctggcgctgcaggacagcagggagggtggctcggtgccccggtcttcaccgggctgcctgtgtttggctctaggacatccctacgggcgcagacagctgtgtgacgagtctgtcctgtgattcccaccgctcactcatcgtggctggcctcggtgacggctccatccgcgtctacgacagaaggatggcactcagcgaatggtaccttgaccctgtcctctccctccccgagtgctggcagggtaccttccaggtggtagggccgtgtcactgccatttggttgggtccaggtttctcagtgagatgcaaagcttccccaggagcctgcagtggcgtatttaggccagtcctgggctccccaaagccgccaggcccgtcccactgaggcccatcccacaaaggtctgccccacagaggtccaccccacagcctatggaggagcacaggggacaggccatgtgggatgagccagtggactggaggcagaggctgtcggggtgaggcagggccgcagccaggcacctgccacctctgagctcacctgaacagaatactgccactgcctgccacctcctgggtcatgcagcaagtgtctggggagggatgtctgagggcacacacgtgggcacagcagccctgggcactgcctccactgagcacccctgtgggcaggtgctgtccgcgtctggcagaggacagggtacacgcatgggcacagcagccctgggcactgcctccactgagcacccctgtgggcaggtgctgtccatgtctggcaggggacagggcacacgcgtgggcacagcagccccgggcactgcctctgctgagcacccccgtgggcaggtgctgtccgggcctagcaggggacagtccgtcttggcccacacggctcatgcagcagaagtaaatttcacccagcacagagcgaggattcccagaaggtccttgtgcctccagcttcatcagctttaggtctgggattctcattcctgaccctccagtctgcacagatcggggagacacaatgaggagttttgagggaagcaaagcaaagggtgggcagggcctgggagcgctgcgatggccgcctggcccccgtctctgggcagcttccatgtggctcagacagtcctccagcggcctgacggtgacctagggcccagccctgagccagcctggggaggacacagggggtctctgctggagcaggtcacctggagggggctctgaccctgcgtgagcactagcccctcgtggggagcggacgggcgagggcctgcggacccgctggcacaggcagacctgggcagctcccggtgagagccccgaagggtggggacgtccttcagggaagccccacgctgagcgtgccccctcccctacagccgcgtcatgacgtaccgggagcacacagcctgggtggtgaaggcctccctgcagaagcgtcccgacggccacatcgtgagtgtgaggtgaggagcgccgatatttagcagccgttctgctgtaaaaacattattttcccctccatttaaaatacgtccttggtatttaaacagctggaaggggatggcatttcgggcagtaattaactcctgccctggaactggccagaaagatcaggcgcagcccgtaggggcccaggggccacagctgctcccctgctgggggacacctgacctgcaggcgctttgggaactttcctgggctgccaactgcggagggttccggggggagttgggcagctgctctccctccacgggcaggggtggcagggtggcaggggcggcgcgtctgccaggcacgtggcagttgtctgcacataaattcagttctgcctcttggtaaatacagcaccaagagcagggaatatttatttgcctattaaaggaagagcaagatgtaatttatgaatgcaaagccagcatttcttcaaagagatgctcttttcccccttgtttgtgatataaaaaccaaacataactcttgggatggacgcctgctgggggtggaaggcaggagccacggggcctcaaaagggccaggccatccctctctcgggccacagcctgccatccaggctctgtctcccgggactgcaggccccggttgcatgaaatctaatctctagctggaaatgaaaccaggagctcacagcctcctcccgcatctgtgctcatggtcatttctctaggccagaaagctccgcgccttttctggctctgagagagcttgtgggggacagccttggccctgagaccagtatgggtgcatgtctgggccccacctgggcagccctcactggggacgctgagcatccaggcagctttttccttgagcagtgtgtgtgcaaacaggtgtgcgaccccacacacctggttccaccgtccccctggccaggcccctcatggggcctccgggaggaggtgtcactgtgaccctctcttggcagcgtcaatggagatgtgcgcatctttgatccccggatgcctgagtcggtaaatgtgcttcagatcgtgaaggggctgacggccctggacatccacccccaggcggacctgatcgcatggtaggcgccacccacctccctggcctgcaccgctcacccgcctcgggcctctgtgcaaacgggaggctcttgtgttcctgcccccaggagctgaaggagggcaggggaggatttcactgctgtggggacataaaaacaaaagatgtctgcccaccacatcctcccaggataaactctcagggccctgccaggcccgagtcctcagtgagagtgaccagagggtcacacctgccccgagccagcctgtccccgtggtctagccggcctgtccccgcggtctcggcatctgcgcccatcttccatcctcaaagaagagggcagtgatgccgggaccctttctctccccacagtggctccgtcaatcagttcaccgccatctacaacagcagcggagagctcatcaacaacatcaagtactacgacggcttcatgggccagcgggtcggcgccatcagctgcctggccttccacccgcactgggtcagtgtggcggtgggtgggggtcgggggtcgggggctggggtagagggatgggaggcaaggggacaaggcagcaggggtcctgcctggctaccccacaccacagtggggcccattggctgcctgagggagggacttgcctgggtcccaggatctctagggcccctgccccaccctgcactcgccccggaagcagagccccagtcccgtcactccgggaggaattgacacacagtggctggggcaaagctcctgccctcagaccctgcactaaagccatccctggggacctccaggagagtcgctcggggtgtccatccctgtgcggccctcaccccgtcccctgtgcggccctcaccccgtcccctctgcggccctcaccccgtcccctctgcggccctcaccccgtcccctgtgcggccctcaccccgtcccctgtgcggccctcaccccgtcccctctgcggccctcaccccgtcccctctgcggccctcaccccgtcccctgtgcggccctcaccccgtcccctgtgcggccctcaccccgtcccctctgcggccctcaccccgtcccctctgcgtccctcaccccgtcccctctgcgtccctcaccccgtcccctgtgcggccctcaccccgtcccctgtgcggccctcaccccgtcccctctgcggccctcaccccgtcccctctgcggccctcaccccgtcccctctgcggccctcaccccgtcccctctgcggccctcaccccgtccgctgtgcggccgagtcctcaccctgtcccctgtgcggccgggccccacctgcacggctctctggccttggttgcagcctccccacgtggcttcaggccgttgtttttagattaggattctgcccacctgccgccttgtgttgtgaggctccaggcatgtagctctgctgacacgtgtgacattggatcccagagctgccccgtggggcagtcctgaaaaaaccacgcagggcccggggcagcgccacgcccctcacggagtgcaccatgcatgggccctgcagaggactggtgggaccggcccggcatttccgggcctgaggtgggcgtgggggttcctgagaccccggcaggagctgcctaaggatgcgggttggcctgcgcccccccgccccccgcagtgtctgcccgcacctgaacccctgctcaccccttctctctccttgcagcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccacgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcagactccg

SEQ ID NO: 386 - DNA, 421549 bp, Homo sapiens; identical to SEQ ID NO: 385
  source 1..421549: mol_type = genomic DNA

SEQ ID NO: 387 - DNA, 98858 bp, Homo sapiens
  source 1..98858: mol_type = genomic DNA
gactatttaacaaaaatatttaatgctgccaaaaagtataaaaatacagtaggaatggcagtacaatacaaagtaatctcccctaatttatttcttgtacatctttctacatttcatacactcattaaaaacacttaacacatccaattaaaggttctgcaaagtcttctgctggtgggtgctcttcatcccctggatgtaaagtttactttgtaaacaaacaactgtgaggcaatctagagggttagcgagcctcactttagtttccggagtgggcttcaggtcttgctttgcacatcaatggttcaaaatttatagctgcagaatattctcaagtcatgaatattaggtgtctgtcaatcttggcctaaaacataaaataagaagtcatctattcaattcatatttaccaaacacacagacgaacatagatgcacacaaacataaaaggactaacaatgaactgaaaaggtgaccaaaaatcattcccacatgacacattcaaccacactaagtgctgcactgttatcttagggtaaaacggctggggtgctggatttccaaacgatggtggtgtgacgcggcctcatgtggaagcatcgtgacttatattcttcttcaagaattatgtgaattcttaaggtcatcttattttactcaagaagtgacctctgtgtgataccgacagacagacaggttttaaaaataatgtacccacaagaatttagcaagactttatactatgtgctagacttaccaatactttggaattcaatgcaaaagtctaatccaatttggacctccactgtgtaatactgctaaaaatattatcaacataatgtttgaacataaagttggcctatatttttaaaccacaggttgttagcagatgctttttgtcctgaaggataatactaacaattatatctaccgaaatgaagtgacccaatcttaagctactactaatataaaatacataattgacagatttattgtattttaatgccataaagtaaaaataaatgagaattcaaataagcaacagatggatggaatgactattgtaagggcagttgagtttttgatgtcacctcccaaactttgcaagtaacaactttttaggaggtcaatggtatttccattcttcccccaactcccctcagtaccgcaaaacctccaaatctaagtacttgtcagtattgtatcttcacatatatattaagaaataggaaatacaaatcatatccacacatttagtcaaaaactcccaaatgctgagaattaggctactccctttaaagacagggcacttggcataattgtaccaagcaccttggtgttctgaacgtcctttttttctctgattatccaacagtgacggagaaatgtcaagtcatcaagaaaacattctcattagataatgtgagcccacaactactatgggtgtttattacatgaatcttcagaatgtgaaccaaagtggctgaaggtactttgtattgattctgagtgctgcaaaatatatatgttttccatgcatccagaagtctttttaaaataagcaactcaattcaatcaaagtgaatgaagtaatgatctggtttagagaatactctgatgttctagtatttctctgttgcagtggtagttcaaactggtgcacaaagttttttaaatgtgctccatttaaaaactagagaattactttggattttaacaggtaagagtggttgtctattactttcccacttaaatatctcatttaaatattccattaaaaacagagtccgtgtaacataaaagaaaaagtatgaggtttggagttactggaagtctacagactgcagagtgaatctcagttctgtcatgtactagctgtgcaatcttgggcaagttacttattctttgactcagttttctcatctgaatatagggagaatgctgtttacctagaagaggtgttacgtgggttaaatttagattatgtatttaagctggctggcagaattttaagtgttcaccatacctcatgtccttccccagtattttgttacagatatacttaccaagaatgaactatcatttataacaactgaaggacggggtttttaaaaattcacgttattatttctttgtaaatattattcagggtgggggggtaagaaaatacggttaaatcattgggaggcttaattgttttaaagactttacttgcaagactgaaaagacaaatgggctccattttagaaaattctaatagattcacttgaatcaatttttgctatttttatttaaaaaggcaaaggcaggagaaacgggttcaaataagtcaaatgaaacaaacgtggtgctttctgtggagacagtggctctgacacaccactttatgctagaaaggcgcaagggccgggtgggtgtggacagagggtccactaccaagtcagctctatgcctgaggccacgaaaagccaaattgcaccaagaataggttttgccaccagatatccacactaatattctactaaactgaattgaggctaatcagaaacttctcttaaggtgcaaagatgctctacagatgacttacctaggttcccgctcctgaattaactaaactcaaaataactgaagtttttaacagcagaaatttgatgtatcaagagcaacctgtgtctgaaaaatatgccaaattagagccacaataaagaataacttgatgcgtctttaaaaaatggtctgtataaagaaaaaaattcctgtgcaattcttggagctcctcaaaacatactgtataacgtaaaaccagaaagtcgtgaagcagtttctgtaacatcttcaccaaattgcataattcccaccttccattctaaatttaaaaaaataaagtaggaagagttcaaaagtttgaacttttcaaattctcccaatggatcgcccagagagggggatcagggcttttttttttttttttttttaaatagagtggggtttcaccgtgttgcccaggctggtctcgaacccctgggctcaaatgattctccagcctcggcctcccaaagtactgggattacaggagtgagttaccaagccaggcctggtcagggctctttgaaatgttttccttgtcagactgttaccctttagagacaaggcctcacaaaccaagtaaacacttctatccatcactccttacagtcggcgatggcttcatgctgggctaaatagtatacaacaggagaaaaggctcagcaatggcagtgaggaaaaatgctcccttccctgaaggacaatgagtctttccagaacccagtagacaggggagacagccttaggagaaagcacatgtacagcattgctcaatgctgttcttggagcaatctgaatgtgctaaatattcagaaaattcctgctgccgagggaaaaataaccaaactcatactattttcctagaagttcttacttaaataatactacccaaagaggagtgaaaagcttaaattctcaaatctggatgaacaacataatggctgtattgggagcaggcacacagaacatagccactgagtgtacagttttggaactggagagctcttggtagagcagggattgaggagtccacacaatctgagctgctttccaccaaggcatgtcaccccttatacatattcactggaacaaagacagctgtattttctagtatatctgcacttctaggggcaggtgggattacaggagtgagttaccaagccaggcccagtcagggctcttggcaatgctgtcccatagacactgctttgaagatagctataagggaaagtggaattgaaacgaaacaaatgaactggggagaaggatgagtggaacaggtcaactccagagtaaaccatacaggtggtttttaaatcgtgaaaaaatacatttctattcttcaaaattttatttataaaattctaggcctctaccatgtaaatatgccaaagccaaataagggtttcttaaaagtaaaagagacttcattagctgttggtgtatcaatgggaacgcagaacaggcatttctgctgtgcagttagttctgctatgcactgtgcgtccagcacagccaggcgagggaggacctcagacatctcccctgcagggtgcaacagactgagagcaatctatgccccggctacacatcactgagaacccatgtgtgcacctgctagaaaaacagataaaccaatgtttatagaactggaactcctgcctgaacacagaaagaaatggactacatgcctaatgacatttggcttataatagactacatttttaaaaaacatatatttataaataatctttaaaatatctttatttttatatctattttatatatctctctgtatgtgtgtgtgtgtgtgtgtatatatatatgtatgtatatatgtattatgagagacagagagagagagggagagagagacaaatatacagagagagacaagtctcctctactgcccaggctggagtgcaatggctccatcatagttcactgcagcctcaaacttctgtgcttatgtgatcctcctgcctcagcctcttgagtagctgggactacaggcacgtgccaacatacccagctaaatttttcttttttttttaagtagagacccaggctgatcttgaacaaactcctgggctcaagcaatcctcccaccttggcctcccaaagttctgggaatacaggtgtgagctactgtgaccagcaaagatctctttaaacatgtgtatctgaaaagtaaaaatcaaggcaggctagatttttaagtctgtacaacaaccaggcaggcaatttgggaatgtaggtactcattatggtatacaatagtcaaccaaaacacttttaataccaccaggttctggtctggaactagatatgtaatctagtcagggatattttttctcagagggaagtgagttgcagttgcagtcttcctttgataattatctacttctaggacatgttacacatctgagacttttcaaagacagcaccataaaaggatggagaaatgccagtttcaggctaacaataactacttcataaaattgtgttgaggattaagtagggtaatacgtaaagaaaaaatacagtgtctggcatacagtaaaccatcaataaatggtgctttgaactgactgttgaaagcaaaggagttgatataaaaactggaagactgtttcatatcataaactgctttttaaaccaatacacatttttcgattcataccaccaactttagtttaagacaaagaggacaggcacaagtgcacattagcttacagtcagaaccccttctgctgacataccattaaaagaaaatgattaacacattttttttcttcctttctcttttcttggtcattccttggtagaaatattaaaacaataatgaaatggactaagaacataaaaggaccaaaagacagaaaacctcacaaatgtataaagtctcctctaacacaagaaatggtctaaagtcctccatgtgcttattacatgttacttttcttaaccctttaagaatgcagaaaatgggtattttcatttttatatggatacattaaacatggagaattatatttttacattctatatatgtgcaagcatagataaaactcagtcataggctaacataaaataaatacttggttaatattggaaaggaatatataacttgttggtgtagctagagaacacagcattaaaccaaaggttgctgtcaatctattagcagaaatagatatgagtggaaatgaactagatatgaattaaaaactcctgaaaataaaagaaacattttttttataattttttcttccttaagcaacactacatcattcaagtcaaagtatatatctgactcttaaaatctgttaaaattagaaaatatttaatattatgaggacctaaggatacaacaagttttttaaagctgtagaacccatctagaattgctaactttttcctctggctgttaccagagaaggcagccacgtctgtctctttgaccagcacacctcattcaataaaaagtcaggactttttatcatgggcacaacacgatgtcatgtgttttcatgacatccaccaaaaaatattattactggtaaaaactgaacactatttaaagcatccactgtcaatgcccttctcaaggatctgctcagagaaggaaagatgactaaccttagaagtgtaccaacaagtgttcatcacactgaatgtggttttaaaaatatatgcgacaccacccagaaggacagaaagcatacagaaagcaaagcgtaagccaatgaagcgcattcagccagctgaggggtgaggcacgtcctctctggcactggcttcctcaagtcttcacctgtgtaccgaaagcaagcctagtttcaactggaaatgtcataaggtctacctgtatgtgacttgcagagtaacataaacatactgcatttagcaaagacaaaccaatgcaaactggaaagaggttttaaaccaataacaacctgaaatgtaagggtcttggatgcctcaacacaggtttaatgcagacagacataaaaaaatgtccctcttacctcctctccatttcaaggttacaggacacagtaatactgaatcaggacacaggcacatgttatataaatcttatttaatatgtagtaccacctacatcctgctttcatactttcaacataatttaacacattcaaggagactatgcaaatcaattcaaaatatctatctataccaatggttttcaaactttttttttttttttttttgagacgaagtcttgctctgttgccaggctggagtgcagtggtgcaatctcggctcactgcaacctctgcctcccgggttcaagtgattctcctgccttagcctcccaaggagctgggactacaggcatgcaccaccacgcccagataatttttgtatttttagtaaagaagggatttcaccatgttggccaggacagtctccatctcttgacctcgtgatccgcccgccttggccttccgaagtgctgggattacaagcgtgagccaccacacccggcccaaactgttttttttgtttgtttcttttgagatggagtctcgctctgtcgccctggctggagtgcagtgacgtgatctcagctcactgcaacctccatctcctgggttcaagcaattctcctacctcagcctcctgagtagctgagattacaggtgccctccaccatgcccagctaatttttgcatttttagtagagatggtgtttcaccacgttggccaggctggtcttgaactcctgacctcaggtgatctgcccacttcagcctcccaaagtgctgggattacaggcatgagccaccgcgcccgaccaaactgtttttaaatgataactgccccctttaaaatacttaagccttatgcagaaatcttatgtggcatataaagagacaaggcagagatgctgtggttgaaagtaacctcttgacccacctggacatccaatgagcatagtttgaaaaccactgaaataaggtatgctatccataataatgtatgctatccatgcctcctagcaattaaatttgtaacaacaatttcaagtttaagtaagacaaattaaacactgaatggaatgttgaaatctgaggaaagctagcattcaaatgagcagttaaattcattaaacagtttgctttaaaaaatattcattaagttaaaatgacaatgtaaggtttgcatataatcatactatttattgaagtagaaagaaactgaaaagtgtttacttcaaaacttcagtctagtaaactgaaattatgaatcataaaatgctgcttcttacttttgcttcctaaatcataatctaccccaactacattgaaattttcatgaaaaataaacatatcaataatgggatttacagaaaccaatttctttacaaagtcttgaccaactgtttacctgactatcccagtaaggagaattttccttcaaagatatttttaggaaaaacttttgtttctttgtttgcttttctttttaaaatggggaaaactgtaaaacataaaagaaatgcaatatatagtagaaattgcttattccaacttctaactgctcatatcaaacttctctttagaaaaatggaaaatgtatccagtacaattcaatcgacatacaatttatttttttagtaacagatttttcaaattgagctcttaaaaagtacagttaactacaaaagattaaatagatacttataaaatatatttaccctgaaatgcttaagaataaaagtgttgatgcccatgtcaatagtacattatacattacacacattatttaaatgtcattttctttccaataacgtagataaaaccacaatatttattgcttatatcaagtgcaggttaaaatccagatagcctccaaaaacaaatcctgtgataaaggatatctcaatgttggtcaggtgaaatactgtgtttgacatgtatgaatacagttgcaaaatttaccagtttttaacaaacatgaatgtctttattttagacagccatttacagtttggggttcagaggaacctgcagtcaagagtcctgagatgttgggcttgtgactgtaaatatcacttatctggttgatgtctattctactgcaccgtttttgggatatgaggcgtttgctgcagacaaacccctatgattaatgtagcactgtcagttactagtgcagaagcttgctgggcaaaattaattgtttatagggcattttgctgaaaaaacagtgtccagccaacaaaagcgccaaccaaaatgactgacataaaccccatcttagtgagaataggttgccaatataaccacctttttctttttcgttcattctcatttagcctctgtttcatctgctgcaccttctgagctgtggtggcctttctgtcctctcgaatacgtttccgtagagcactatgaggaaataaaaacaagtgaaaggaagtgcacacagagcaggacttgagtactctaacacagaggacctaggcgcaaataaaaccatccacatagttttcaccctatttgaacactggaataatgaggggaaaagcctcaatattcttttgagacagcgtcttgctctgtcacccagcctggagtgcagtggtacaatcttggttcactgcaacctctgcctcccacgctcaagtgattctcgtgcctcagcctcccaagtaactgagactgcaggcgtgcaccactatgcccagctaattttttgtatttttagtagagacagggttttgccatgttggccaggctggtcttgaactcctgacctcaagcaattcacccgccttggcctcccaaagtcctgagattacaggtgtgagccacggcgcccggccaagaaaagcctcaatattctttaatgattcagagatgtaccttgacaaccattcctggtacagttttatattgataactgcttttagtgggacctgaaaataagcaaggtactttcttgacacgtgaattgatgactgttagttttctttccttccttgttaactagtcagcaggagcaggagtgggaagacaagggggtaccacttgcatctgatcccatttcctggtcacgtttgatggttaaggctcttataaaagctagctatttaatatttccatgaatattctgttgtgggagcacttattcttttatttgaccatacacatttctacctcccattttcatagtcaatacagaaatttttttggggtggtgggggaggcggggtggatggagtcttgttctgttgcccaggcgggagtgcagtggcacgatcttggctcactgcaacccccgccttccgggttcaagcaattcttctgcctcagcctcccaagtagctgggattacagacgtgcaccaccacgcctggctaatttttttgtatttttagtgagatgatgtttcaccatgttagccaggctggtcttgaactcctgatctcaagtgatccgcccacctcagcctcccaaagtgctgggattacaggcatgagccactgtgtccggtctcagaaattttgtttcagtggaaggtctctgactctcaagatacttagttctggttctatataaataataatgccatccagctactcaggaggacggcttaagcccaggaattcaagtccagcttgtgcaatatagcaagtcttgcctctctataaaagcacacccacaaaaacaaaaaaacggccaatggcaacatataggttactatttcttccattccctcttttcacttttctgtattacagcaaaggcctaaccagcttccctgccctcaaattaaatattattgccatggtaatttttctagagcatacccctggacacgtagcttgatttaaaatctttttttttttttttcgttaccgggcctagtgcacgatggtgcttaaaaatctcaaatgcctcttcaatgtctcctacattgagactacctttttcctggccaagacgtttaacctgaatttaactatgataaataatgattaaagaaatgcattgtatggggcattctaaaagatatctggcctagaagcttcaaaaatacaaatgtcaagcaaggaagaaaaaggcagggaacagttccagattaaaggagaccaaagaatcacatcaactaaatatagtatcaatctttgattaatcttgaaatattttttaaacagctacagaagttgggatcaggaaaatgttctaaaattagatcgtggtgccagctacacaatttggtaaatatattaaaagtcactgaattgtatactttaaatgagtaaactttatgctatataaattatatttccataaaactttattaaaaaagctatatggtgaatctttcagacaagagaaatctgaattgaactatgtattagaatattttaatcaatgttacacttctttggtgtactggaaccttctctccccaagagattgttagtgggaatgtaaaatggttcagctgccacagaaaacagtttgacagctcctcaaaaagttaaacatagagttaccatatgacctagcaattccactcctagatatgtacccaagagaactgagaacacatgtccatgcaaacgcttgccaatattctcctgctatgcagaactttgttcttgccgtttttttgctgttctccaaatttgttccccactaaaatagaaaccttcccttctctcctgtcctctcatttcagttctactcttcaattatcttgctccaccccctctagcccttctattcttacggcatttaatttgaagtaatttataatttactaataatgtgctaacttgggtacttgttttatcttcatcacatattctgcaacttgaggacagactgggttttgctatctttgttcatcttatggtgctttctcatgtctttttcactttttgttatcatatatacaggtatccctggctgtctgaactccatctgaatatctgctataatgacttgcaaaaattcttactcagaattcactctctgaattgaaaattcactatcacaaatatgcatgtacctgttagtgaaaacatttgtgttcaagtgtaggcaaaatatgtataaaaacagagagggggttagcctcccatgggccctttattagcttttgccaggagcctgggggtatcgttaacaaggttccaatttagatataatctttaacgtattatttcattttttattttcattgcggtatagaaggcaattataatttgtatctagtattttgtcatttaccatacaagcccaataatgagtcccttaagtgttatatgattacataattagtgctttaaatgctacataggagtttaaaaggttttgtactatatttgggggaactggttatgctttctggttgggctgacaacacactatttttctcatttaaaagaatggaacagaggtttttgctttccaaaagtgcactatataattcaggaatggactagagacaaataccaaggcatgcctgtatctaatttaagaacacaattccagagaatgacaagactactctcgatttgtgataaaatcttttcttccttagtggggcctaaagaaattatgtctgtgtaatgacttgccaaatgggacctgcccaggttttcccgtatatttatgcaatttaggatattaaccaatgggaatgcctcctgtggacccttgcccagggaagatcatgtggcgtgatcatagctccctgtagcctcaacctcttgggctcaagcaatcctcccacctcagcctcccttaagactacaggcaggtcccaccacatttggcggatttttgtattttttgtagagacagggtttgccatgttgcgcaggctggtcttgaactgctaggctcaagtgatccacccgcctcagcctccccgagtgttgggattacaggcatgagccactctgcctgctccagacttttcgtatgtccaagttgtttctcactctcagtgatctgggtttctgggttgaactgtaattgagaatactgcctttcaaattcagactgcaacctacagtaagaaatagcatcacaacagagtaacctcacacacacacttacataggtacacaatgtatatgtaaatatatggaatttatacatcacacatacatatataaaaacaggttaaaattcaagttcaggggtacgtccatgtgcaggcttgttacataagcttgaaacttgtgtcatctccgtgacatgtacaacaagttttgttgtacagattatttcatcacccaggtattaagcctagtacccattagttatttttcctgattgtccccctcctcccaccctccatcctccgacaggcccccagtgttgttcccctctatgtgtccatgtgttctcatcatttagctctcaattgttagtaagaacatggggtatttggttttctgttcctccattagttttgctaaggataatggcctccagctccatccaagcccctacaaaggacatgatctcattctttattatggatgcatagtattccatgctgtatatgtacattttctttatgcagtctatcattgataggcatttagattgattccatgtcttttctatggtgaatagtgctgcaatcaacatacgcgtgtgtttacatctttacagtacaatgatttatattcttttgggtgtatacccagtaatgggattgctgggttgaatggtatttctgtttttaggtctttgaggaatcaccacactgtcttccacaatagttgaactaatttatactcccaccaacagtgtttaagcattcctttttctccacaacctcgccagcatctgttaaattcatgttattatttgtgatatgctgataatttctattttattctattttcttctttaaaaaatgtttataatccaataaacttcacgactatgtgatttgaccttcaatttgaaaaacactgctttggaggatgaatatcctccaaatgaatacaatgaaaatgaatacaagaaagtactgtgttctatttcttttgaaagttgaaattctggccaggtgtggtggctcatgtctgtaatcccagcactttgggaggctgaggcgggaggatcacaaggtcaggagttcgagaccagcctggccaacatggtgaaaccctgcctctactaaaaatacaaaaattagctgggtgtagtggcgggggcctgtaatcccagctacttgggaggctaaggcaggagaattgcttgaacccgggaggtggaggttgcagtgagccaagactgcgccactgcacttcagcctgggtgacagagcaagactccgtctcaggaaaaaaaaaaagaaaaaaaagaaacttgaaattcttttgataagacttttatgaggatctttaatgcaaagctatctataggtattaaaaattactgggactgattaaaaaataaaactgttcagagtaacctttacttcacaccctgatcctatgctcttcttttacatttttttttttttgagataagagtcttgctctgttgcccagtctggagtgcagtgttatgatctcggctcactgcaacctcctgggttcaagcaattctcccacctcagcctcccaagaagctgggacaacaggcgttaatgcctctttaatttttgtattttaaaattcgtatgtccaagttgtttctcactctcagtgcctggttaatttttgtattttcagcagagacggggtttcaccatgttggccaggctggtctcaaactcctgacctcaagtgatccacctgccttgacctcccacagcactgagattacaagcgtgagccaccacgcccggcctcctctttttcatttctgtaaccttgtttttgtaatcagacttctccgcttagaattctgacttttctgttgggactctctgctttcaaacatgcaccagtctcatttatcagacagggaaggaaaaaagggaaagaagaaaacaccgccaccacatgcgaaaacatgtacaggcacataaacacacacacagaccccataaaacagtcttctgcaatcactctataactccttagagttatagactctagagtggttttagtagtctcctctgtatttgcaagcttgtatgagtgatttaactcactaggattaacatggttgttctgaatctttgtagattaaaactcaacacttctgaaatactaagaatgccatttcagtcatcaagcctgtttttcatttaattctgcagatagtactagataaaaggggggaaaaagcagtaacactaggaatctgaaagccttattattgaaaaagctaaggtaacttaaaactattatttcctgatttaaagatattctatttaagatgaaaaaaggaaccaaaaaaattatgctttctcttgcagtctaaaactactgaagtcaaaaattgggaataacattactaaatcataataaactcttccactataatatataataatacatgtattatatattggaatatgttagcatttataaaatttcaggtatttaatttttatattaggaaaatacagcagtaaagctataatgtatggcagacttcgactattttcattccaatctaacaaatataaccacaagataaaattccccatgataagaagtatatttggcaaaaagagaagaagaaaagttattcagagatgcaggagagaggaaagaaaaacctcattcactttgctatgtgacttataccaggttatcagcttcctaatctgtgagagacagtcttagaaatgtaattgtaatttaaaattctgaatagatgccacattcatatggatttttaaaaaacgcctttttctttctccagtaatgcaattaagcttacatgtttaaatgttttattaaaggcatattatcagttacattataattatagtacaaatggcaggtattcatactacttattttctgtaccataccatatattttagcacccaattatattaacttttacactcaatcattattgttttaaaggatttttgaactggtttctaagtattggctgaaagctccttaagaacacctttgtcatcatatactaaataccctcaggtaagaaataaaggttatattaatttggctgggcacggtggctcacgcctgtaatcccagcactttgggaggctgaggcgggtggatgacctgaggtcaggagttcaagaccagccttgttaacatggtgaaaccctctctctactaaaaatacaaaaattagctggacatggtggtgggcgcctgtaatcccagctacatgggagggctgaggcaggagaattgcttgaacccaggaggtggagcagctaaggttgtgccaccgcactctagcctgggtgacagagaaaaaaaaaggttatattaattcaataaaaaaaagggcctatattatttcatatatcatatccacataattatttatttattattattatttatgagacagggtcttgctttgtcacccaggtgggagtgcagtggtggtatgtcagctcactgcaacctcgacctccccagctcaagtgatcctcccacttcagtctcccgagtggctgggaccacaggctcgcatcaccacacctggctaattttgtttattttctgtagagataaggtctcactatgttgcccaggctggtttcaaactcctagactcaagtgatcttccctccttggcctcccaaagtgttgagattacaggcgtgattgtattttcctaatataaaaattacatacctgaaatcctatggcacctggtcccataaaatttatttttaaaataaaaaagcctcatctttcagcctgtagttatagaaagcttacctctcactgttctcctccattgtatcttgcattttagaggaaagtcctgtacatcggtcacctgtcagtttttcttcttctagacctattctgttcccattgtatttttcagtcattattttgtttggtgaatgatcaaaggcaggagataagtcttccttagaaagttctttccatcgtttctaggtagggaagagaaatgaaaaacaaatgcaaacattaaaaatttattttccttaaataaaaaaatttatgaattaaaatcctatattcaagttaagaaaacccaatgatgctaaaagatgagtgaaaaagaaaaaggcattttgccatactgtagcttgtaacaactatgcttattttaatttcaaaattttataataaagcatttagtatttatgtacatgagtatatagttgaatataataatcttaataaaatcttgtggacttttacctatttgagacaaactatactgggaccacactcaactattagtcacagtaatataattttaatattggtagccagatccatgaaactcgacagcacactgaacacattcaatgcaaagaggtcctctctccaaggtacattataataaagccatcaaaagtcagacatagagaattctaaaagcagcaagagaaaaggatcaagtcacatgtaagggaacctggcaggttgctattaacagatttctcagaaaacctgtacacgccaagaaagaacagactgtagagaatgggataatatattcaaagtgctgaaagataacaactactagcaaagctatctttcagaaatgaaagaaaaatggagtctttcccagacaagcaaaagctgcaagaatttattaccactagactagccttacaagaaatgcttaagggagctgctttgactggaagcaaaagtataattactatcatgaaaatatatgaaaatataatctcactgacagaggtaaattaattaccaaattcagaaaactccattgctgtaactgtggaatataatctttcaaatctccattatgaaggttaaaagtaaaaaatggttaatggtaactacagctacaagttgttaaggaccacacaatataaaaagatgtaaattaagcaacaaaattataagttgtggggggagggtaaaagccaaaaatattttatgagaccaaggttaagttattatcagcttaaaacactctaagatgtttaatgtaagccccagagtaaccacaaagaaaaaaagtaactacagcagacacacaaatgagaaagagaaataaatcaaagcttatcactatagaaaatcaccaaaccacaaaggtaaacaataagagagaaagaaaggaataaagaatatgaaaagcaaacagaaaacaattaacaaaatggcaggtgtaagtccttatctatcaataatacccttgaatgtaaatagattaaatacttcaatgaaaagatacagtggctgaatggatgaaaaaacaaaaaacaaaatccaactctatgttgcctacaagacactcacttcacctgtaaggacacactaagactgaaagtgaagggatgagaaatgatactccatgcaaattaaaaccaaaaagagaagaggagtagctatattttgataaaatagactttaggtcaaaaattgtaaaaagaaacaaaggtcaaaggggtcagttcagcaggaggatgtaatgattttaaatatctatgcacacaacactggtgcacacaaatatataaagcaagtattattacatctaaagggagacatagactgcaatacaataatagcaggagaacgctacatcccactttcagcaatggacagatcatccagacataaaatcaacaaaaaaacattggatttaaactgcactctaggccaaatggacctaacacacatttacagaacattccctccaacagccacagaatacacatttttctcatcagcacatggaacattctccatgatggaccatatgttaggccacaaaaacaagtctcaacaaattaaaaaaagaaaaaaatcacaatcaggccaggtgggtggctcacacccaagaactttgggaggtagaggctggaggatcacctgaggtgaggagtttgagaccagcctggccaacatggtgaaatgccatctctaccataaattagccaggagtggtggtgggcacctgtaattccaagtatttgggaagctgaggcataagaatcacttgaacccgggaggcggaggttgcactgagccaaaatcatgccactgcactccagtctaggggtcagagtgaaactgtctcaaaaaaaaaaaaaaaaaaaagaaaaagaaagttctcaaataaacaacctgatgtacctcaaggaactagaaaataataaactaaacccaaaattagcagaacaaagaaaataataaagaccagaagaatggaaataaagtgaccaaaaaaaagaaacgaaagatcaacaaaaccaaggatcatttttttgaaaaggcaaacaaaatcaacaaacctatagcagactaagaaaaaaaaaagactcaaatcagagatgaaaaaggagatattacaactaataccataaacaaagtattgtaagagactattataaacaactgtatgccaacaaattgaaaagcctagaggaaatggctaaattcttagacacacacgaactatcaaaacggaaccatgaagacatagaaaacctgaactgaccaataaagagtgagattaaatcagtaataaaaagtctcccatcaaagaaaagcccggacttgatggcttcatggctgaattctaacaaacatttaaataatactaattcctttcacactattcaaaaaactgaagagggaaatcttccaaaatcattctgtaaggccagcattaccctgataccaaaaccagacaaggacacaacaaaaaagaaaactacaggccaatatccttgatgaatatggatgcaaaaatcctgaatgaaataatagcaaattgaattcaacagtatattaaaaacatcatttaccatgaccaagtgggattcatccaagggatgaaaggatggttcaacatatgtaaatcaataaacatgatctctcaaaaatcaacagaatcaaggacaagaaccatatgatcatttcaacagatgcagaaaaaccatttgataaaattcaacatagcggctgggcgtggtggttcatgcctgtaatcccagcactttgggaggctgaggtgggtgaatcacttgaggtcaggcgtttgggactggtctggccaacatggtgaaaccccatctctactataaatacaaaaaatagctgggtgtggtggtgcatgcctgtaatcccagccactcaggtggctgaggcatgagaatcgcttgaacccagaaggcggaggtagcagtgagccgagattgcaccactgcactccagcctgggcaacagagcaagactctgtctcaaaaaaaaaaaaaaattcaacataccttcatgataaaaactctcaacaaattaagtatggaggaaattgtgcctcaacacaaagccacgttatgacaaacccatagttaatatcatactgaacatgaaaaagttgaaagcttttcctcttaagatctggaacaagacaaagatgcctcctttcttttttttttttttttttgagatggagtcttgctctgtcaccaggctggagtgcagtggcatgatctgcaacctctgcctcccaggttcaagcgattctcctgcctcagcctcccgagtagctgggactacaggcgcgtgccagcatacccagctaatttttgtatttttagtagaggcagagtttcaccatgttggccagggtggtctcaatctcttgacctcatgatctgcccatctcagccccccaaagtgctgggattacaggcatgagccaccgcaccgggctaggatgcccactttcaacacttttattcagcataatactgtaagtcctagccagagcaattagctaagagaaagggtattcaaattggaaaggaggaagtcaaattgtctctgtttgcagaagacataatcttatgtatagaaaaccctatagactctaccaaaaaactgttataactaataaaaaaaatcagtaaagttgcaggatacaaaatcaacaaataaaaatcagtagaattttatacatcactaacaaactatctgaaaaaagaaatcaagaaagcaattccattttcaaaaaaattacctaggaataaatttaaccaaggaggtgaaagatctctataatgaaaattataaaacattaatggaaaaagttgaagaggacacaaatggaaagatagcctatgttcatggattaaaattaatactgttaaaatgtccatactacataaagtgatctacagattcaatgcaattcaatgaaaataccaatgatattcttcacagaaacagaataaataatcctaaaatttgtatgaaatcataaaagaccccaaaagccaaagcaattttgagcaaaaagctgggggcatcacactacctgacctcaaaatatactacaaagctatagtaaccaaaatagcatgctactatcataagaacaggtataaagaccaataaaacagaagacagagcatggaaataaatctacgtatttacagccaatttatttttgacaaagatgccaagaatatacactggtgaaggacagtctctttgataaatggtgttgggaacactggatatctagatgcccaagaatgaaactagacccctatctctcaccatattaaaaaatcaactcaaaatggactaaagacttaaatatgagaccccaaacaaatatacatactagaagaaaagatagggaaacacttcaggacattggtctgggcaagggaagggtcttttgtataagacctcaaaagcaaaaacagacaaatgggattacatcaaactaaaaagcttctgtatagcaaaggaagcaatcgatagactgaagagacaatctacagaatggaagaaaatatctgcaaactatacatttgacagggattaatatccagaatatataagaaactcaaacaaaattcaatagcagaaaacacaagtaatccaattaaaaataggtaaaagacctgaatagccatttcttaaaagacatacaaagagccaacagatacatgagaaaatggtcaatatcactaatcatcagaataatgcaaatcaataccacactgagatatcaccacaccccaattagaatgactattatcaaaaagacaaaaaataaatgctggcatgaatgtggagaaaggggaactcttgtacacggctggtggaatgtaaattagtacagccatcttggaaaacagcataaaggttccttaaaagattaaaaatagaactatcatatgatccagcaatcccactactgggtatttatccaaaggaaatgaaattaggatttcaaaggcatatcggcactcctgtgcttattgcagcactattcacagtagtcaagatacggaatcaacctaaatgtccatcaatgaatggagggagaaagaaaatgtggaaaaaaaaaaaaaaaaaaatatatatatatatatataatataatactatttggccattaaaaaaaaaagaaatcctgtcttttgtggcaaaatggatgaaactggaggacattaagccaagtacacaaagacaaatactgtatgttctcactcatatgtggaatctaaaaatgttaatctcatagaagcagagagtagaatagtacctactggaggcttcgcagagtagggaagagggggcatagtgagaaactgaacaacagttcaacagggggatgagttctggtgttttactgcacagaatgactatggttaataatatttaatatttcagacagggtgtggtggctcatgcctgcaattctagcagtttgggaggctagggcgggcagatcgcttgagcccaggagtttgagatcagcctgggcaacatggtgagacccagtctctacaaaaatttaaaaattagccatatgtggtggcacgcgcctgcagtcccaattacttaagagactagggcaggaggatcacttgagcccaggaggcggaggctacagtgagcgagccatgatcgtgccactgtacaccagcatgaacaagagaatgagaccctatctcgaaaaaaatttatatacatacacattttatatacacataaaatcctctcttctggctatttcgaaatacttatatatacttatatatatttcaagtactatgaaatatattagcacataataatatataattaaatagagatttcaaaatagctggaagagaggattttgaacgttttcaccacaaagaaaagataaatgtatgaggtgatagacgtgctagtctaatttggtcattacataaatgtatcaaaatatcacactgaaccccataaatatgtacaattactaagtgtcaattaaaaacaaaggccggggcatgcggtggctcacgcctgtaatcccaacactttgggaggctgaggcaggtggatcaagaggtcaggagatcgagaccatcctagctaacatggtgaaaccccatctctactaaaaatacaaaataattagctgggtgtggtggcacacgcctatagtcccagctactcgggaggctgaggtaggagaatcacttgaccccaggaggcggaggttgcagtgagctgagatcacaccactgcactcctgggcgacagagcgagactccgtctcaaaagaaccaaccaaccaacagacaaaaaaacaaaataaaaaataaagtagcactgcacaaaaaacacaaaaatttttaaaaagatttcagccaaggtagattttgcttgaatcttaatccacttctaatccagaggtatgtaacactggagtagtcaccacagtggtgcttgaatgtgatctggaaccttcttgctccttgccactgttcagtctaggggagaactaacggtgagatctccaagctggtccttgtgatgctaaaggactttaatttggttgtgtctatcaggtacgctagcagctccaggcagctggctagcccaccactgggctagagaaacaccctccagcatgcctctagcatggccttcaggagtagatggcaacacaaaccaggattcggaccaagatgaagacaaatttcagtttcttctatgaaagaggatgtcatcatctaccctgggagacagttgtgattaatgagatggcatgtgaagcgcccagcatcatgtctagaaaatatgtttcctgtgctctcacttgtcaccattcctagggacaaaggtagaggaagaagagtgtatctgggcccctgcagatgaaagcagtgacaattgtacatgccagagaagaaaaacgcatatataacctatgcactgggactatagtctctcaagtccttgaaaggatgaaacatgatccccatctatgtatctgccagtggcaagtggtagaggcagaagcagtgggagccaatggttttgattacctatgactgacactggcccaaatgacttggtatggacagggatggccttctttgaagatcctatcaaggacgcaaggagtcttggatctaataaataaggaatactctacttattgcccgaggagtctaatgattttggacagagatgtaacattgcaacttaaagttttttagaacttatggaatattcattccctggagttactcttgtgcaatatggtactgttaaaagcaatgcttgtattcagatctttaaaaaatctctgggaaatccattcatacaatggataaactagtttctaatttgtctcattgtcatcatgtaccagaggtattaaaaagaaaaaggcacgcctggcacagtggctcatgcctgtaatctcagcactttgggaggctgaggtgggcagatcacttgaggtcaggagtttgagaccagcctgggcaacatggtgaaaccccatctctaccaaaaatacaaaaattagctgggtgtggtggcacatgcctgtaatcccagttacttgggaggctgaggtagaagaattgcttgaacccgggaggccgaggttgtagtgagctgagattgtgccactgtactctagcctgggtgaaagatgagactcggtgtcatggagaaaccctgtctctactaaaaatacaaaattagccaggcatggtggtgcaagcctgtaatcccagctacttgggaggctgaggcaggagaattgcatgaatctgggaggcggaggttgcagtgagccgagatcacgccactgcaatccagcctgggcaacaacagtgaaactctgtttcaaaaaaaaaagcattttccacacttcaccgttcccagatatggctattttacttagctgcataatcaatgtacctctttttatgtttttaatttttttagagatggggtcttactctgttgcccaggccagaatgcaatggtgtgatcacagctcactgtagcctcaaactcctgggctcaagcagtcctcctgtctcagattcctgagtagctgggactataggagagaactaccacggctggcttttttgttttataatagttgatttacagaagatttagaaaatgtgaaattctacagtttgttgtgtttggagaacagttagtagtacagtttggtacaatttgtctagaggatggaaaacacgcaaagcttgagtaggagagatgaggctggaaaggaaatagacctccgggaaagaggtctctggacttcatgagtagtggggtagaactgaaaatcctgagccctaagagggcgcaaaccatgtccccgaaagaatactgtgccaacaatcaagaaactacaatataatggaacacaggagtaattaaggatgtcttcacttagatgactgtctattttctttgttcccttgtttgttttgttactcaatccaaatcttttatagtgaagacatggagtacttgctactctccatgccatattctaacacttcaaatgtgctagctcttaatcctcacaataaccttaggagataagcactaatactaatattaccattattacaccctttttacggaagatgtggggagaataattaggtaactcgcccaaggatatgcacctaacaaatagtagagacagaattttaacctaggcaagtctgggttgactatgctgtgaccccttataaagatgtgtgttcaacaaagtaccccacaaaaatgttaaattgtctccagaatttacactggtcaatttttgaagtttccactcttgactgagacctagttatgtaacttggccttatagctggacaacactcaacaatgtcaacaaataagatgacaccaaaaatcaagtctcactggaccacttcccagaatatgcaacaaattcagaatacgtcaacaaggaaagcactcggcagagagagaaataaaagagatatttaatgctagtgaattaaaaaaaccccacaaacccaacaatgtcattttgccatggctatgttcagcaaactcactcatggctatgttcgacagactcattcatggctatgatcagcagactcactcgtgcctatgttcagcaaactcactcatgcctatataggttcagcaaactcactcgtctctgtcctccctgtgacacacaagggagccagcactcctgagtcacctgcctcaggtcattaatgctgactggtgaagccaaggaattacatttcactaaactataacctcaaaggagctctcattttgaggcctggtactgtttcatctttctttctaattctgtgctcacgttgcaccaacccatgagtcactgccactaggagccatgccccccacacaatgcctagaaccctagctctacccatttctctcactgaagaaagctttaagcaatgcaattaaacttcaaatcctctgtaatttgttaaaagtttatcatttacatttaatactttattagtaatatcaaattaccagctagagatcttacaacattagttctgaattgccaaactagatatttactctggggggttaactgtcatcatcaatactgggaatatgctaataaatatgtggtaataccagcaaccagcttaagtatttatgcctgaccttgtgctgaaaggcaattgcaaatagcctatatgtctataggaatgtcaaagtcattggaagttttctgtaaatgaatacatgctttaagattataattacacatatttacagacttaagatacaatcactttgggctgggtgcggtggctcacgcctgtaatctcagcactttgggacgccgaggtgggcgatcacttgaggtcaggagttcgagaccagcctggtcaacactgtgaaaccccatctctactaaaaatgcaaaattagccaggagtggtggcaggcacctgtaatcccaactactcggaaggctgagtggggagaaccacttgaacctgggaggcagaggctgcagtgaaccgagattgtgccattgcactccagtctgggcaacaagagcaaaactgcgtctcaaaaaaagaaaaaaaaaccagtagcatgtgtggtatgtatttattaatccaactttatcagtaatcacttcatatgccgatggtctaaatgcaccaattaaaaaagattctcagaatgccaagaccatttctgcagaaattaaccccttggaatgggcagcatgcttttctgatcctgagtacctgaaggataaagatgtttccaatatcctatctggaataggggcagaaaatgccttagaattgagagcctgaggacaatatcacaccagataaattaacagaaaaaaaatccttcctagccacaaactgcactgtcaaagactccacaaaaaagtgtgtccagaaaaactcatctctgtgataaaaaaagatccaccctcagataaagtatgtattctaaaactaaagacacaaaacttaaaaaaaaaaaaagcagtggtaggaaagacacaatccaaaggacaatacatttccctcccagttacccgtctcatcacagccaggaagcaggcagggaaggcggcatgcaggctgtgaaggcatggggaaatctgattgaactacttttctttttgaactccagatttaagttggtgaaagctcactgtgattagaaagggaaattttcctaatcttaaacatctgaaataacttttacttcacctaaatcactgatcactgccaaagtgaccctggcaaatccagtgttcccaaagtctggcgtctgaagcaggacatgttctaatgggctgagtttcccaaacattgcgtattttggctctgagtgccctaatgtttctgtgcattaagaatattttaatgctatttaaagatttggaaaaaatctttttaaataaacctttattctgacaccaatggtccgatctaatttacattcttatattggctagtaatcagagaaatgaaagtgctagtaaatatgttcacacatgagaaacataatgaaaagacagtcgatcttcttatattatgcatcaacttacagtatctgcttatgtccaatactatgtgattaaaccagacaaaaaatggagtctgtggttgtttctattttacattttaacttagtacataacacaagtttctgatcagtctttgaacttaggttctacaaatatgcagtaaaaatagcttaatgagaataaagccaccaaccagaagaatataacattttgctggaatttcattatatctgccataaatattcaagttgcttgttgttataaagtcaaatatcacataaaccaagtatcagtgtttaatgaaggcaaaagtatctcaagtttccagttactttaataattaaaagattaaccacccccaaaatgaaaaattcagtttctttaatgaaatcttgtttctacaagggcttttaagtaacacacaggatttaacctgaggctgagtatatatgaggaagctagctaaaattttacaattttaagacagccagctggatttaccacaaaaattcaaatacactctttgaaacaaagacaagggctcaagtggagtgcagttatttgatgctatgtgtatttaacaaatagatatgatttaaaacctgtatgaagtttacctgtatactagaatctccctttatacattttgctccttctattatagccatgtatgagaatctcagttgatctggggtctgaataagacccattcggtattttctcatgttcagtaacacttgttttatgttaatatcatctcctttttccatctgcaagaaaggcaaaaaatgagacaagtcttgttattggaacccaggaaacagaatcaatgcaagatcattgctaagatttttgctatgcattttctcctctgaaagaacaacgataatttaaccctccagctataactgttatgtacacaacaactatcccagcctactcatccctccccacatctcaacccctcaagtagttggaggactttgattctttagctgattcacaactgattccaaaccaatcatagtaatctcattccttctggccagtcattggttaaaggaaggatttataaccagttctggctagtataaggactatttttttttttaaaagtcatggcaggagtcaacctttctgctcattccccttccgcctccttcatgtctgcactacagacacgatgtctggatatacagcacccatctaacaatggtggaaaagaggccaggcatgatggctcatgcctgtaatcccaacactttgggaggccaaatcacttgaggccaggagctagagaccagcctggccaacatcgcgaaatgccatctctactaaaaatacaaaaattagctgggtgtggcggcgcatgtctgtaatcccagctacattggaggctgaggctggagaatcgcctgaacccaggaggcggcggttgcagtgaggtcagatagtgccactatactccagcctgggcgacagagcgagactccatctcaaaaataaataaataaataaataaataaataaataaataaataaataaataaaaatgtggtgggtcacacctgtaatcccagcactttgggaggccaaggtgggcagattatgaggtcaagagattgagaccttcctggacaacatggtaaaaccccgtctctactaaaaatacaaaaattagctgggcatggtggtacgcacttgtagtcccagctactcgggaggctgaggcaggagaatctcttgaacccgggaggcggaggttgcagtgagctgagattgcaccactgcactccaccctggcaacagagcgaaacttcgtctcaaataaataaataaataaataaatagaataataaaataaaatgaagaaagacggtggaaaagacagcaaaagcccagatccacgataacactgctgagctacagcactgctctggactactgacctagtgttagaatccccacacccaggctcaccaaaaataaaagaaaaaaaattgttgaagttatagttggcagggaacaggtgtcattaacaaaataatcaccagagttttaaaactttgatgtaacaatctaattttgattgaagtatactatatatacgcagagtggtaaagtaatacagatgtttagttaagactcaaccgttcccaattcctagctttcattagagatgcaacgtctgaaatgttcttccaagagtatcactccttccaagagtatcactccattgatcaagctccttgtgtgtgtgtttacaatgaaaagcatcatcatattaattcacctgggaatctactttgtgctggcagtcatggtggaaagcataagaatgctgacataactgcaatgaagcatagctacgttttacagaaacatcgaagagactaatacagggccttaaagtcaaggttaagaacaccagtcttgtgtcaagcgtggtggctcaaacctgtaatcccagcattttggcaggctgaggcaagaagatcacttgagcccaggaatttgagactagcctggccaagatagtgaggccttgtctctactaaaaataaaaaagcaaaaactagttgggtgtggtggtgcaggcagctacttgggaggctgaggtgggaggatcacttgagtccaggaggttgaggctgcagtgagcagtgattgcaccattgtactccagcctgggtgacagggcaagactctgtctaaacaaagacaaaaacaaaatccccaccagactgaataccaggacaagctaaactgcttaggttattgataatcttagaacacgctcagaaagcagaaactaagctgcagggactactgaaggagtagatggcatggaaatcaaagcagacagtattattgttgggtttgatcctataataagaggaagaagtaaagacagaagttaggagaagtataagggcaaacagaagtttcatgtatcccaagtaacgaaaaaataaaggtcctaaaaagagaagaaaagatctaggctgtatacaggctgggactgggaatgactggtggagaaagaattagccgttgggggcacagacaggaacctcaggggagtaacagtaatactgacatttatggaatgctcagaaaacatcagggactcttctaagtctccttaatgtattaattcattgaattctcacaggaaccctgtgaagtatgtctatcattatccctagtttttaaatttaaaaaatgagataaagtatctgtctgaggaggaaggaattcaatattacatatgaatttatatttgaaaaaatgtgggggagagacctattatttctgtaatataaagctaccaggaagaaaaacaccttcttagggatctctaaaatcatcatggatacattcctaccagtcatgaataagaggcagttgcaacggtggaaatgagatttttaggtttttccaaaagtagaagtttaagttgaaaaacctcagttctgggatacagcatcagagtttattcactgccagtggaagcaatttaaaaaaaaaaatcaatgagattaaaatgagatcgtaagaagcacttaccaaaacaagacaagtgtctaccagagagaaggtgccagagcgcccaatgcctgcactacagtggatcaccgcaggcccatggtcagggttcaaggagccagattctctcactttaaacaagaaattgagaaatgaagctggtgattcagggactccaaaatctggccaggtagtataatgaaagtgagatattgttctggtttcaccactctaaaaagtgaaaatcaagggagaagttagttctaacttttttcttttaaaaaactacttcagaaagatcatgtgttttatataattctttaaagccatataggctgtttatactatgatttttccatttgttttctgacaatcccatatacaaactagggaagattttctttagtggaaatttgtgatgtattaataatagctaacgcatacaacacttactattttggaggcctgttctaagcactttacttattaactcaatccacacaataatcctattaaagcccattttcctgatgaggaaactgaaacaaagggtaagatagtttgcccaaggtcacacagctggaacatggcagaaccaggatttgaagcaacctggggcagcctttgggttctcagctactaatctgttaccatacatgttaccaatattttctttaattcatgtatcatgaatgggctatttttttctattttaaaaaatttctgccgggtgcaatggctcatgcctgtaatcccagcactttgggaggccgaggtgggcagatcacttgaggtcaggagttcgagaccagcctggccaacatggtgaaaccccgtttctactaaaaatacaaaaaattagccaggcgtggtggcgcgtgcctgtaatctcagctacttgggaggctgaggcaggagaattgcttgaacctgggaggtggaggttgcagtgagcagagatcgtgccattgcacgccagcttgggcaacaagagtgaaactccatcttcaaaaaaaaaaattttttttctaccagtataattttacattctttaacattttcctttttatgaatttcaaagtttattttttaaatataatctcccgttcacatgattatcttttagattctgctacacaggcataggggagcaactcaagaattaatctaaagaaacgatctttatatttttaattggaattgctcctctaaattgttgcctttccccatggcaataatttccaatcctaaagctgtttatatgcttttgctgatgtgctaaagtggtttaccaacatgctaaatgtttcctgtctcttaagcctgcctggtattcactatcgcttcctggatattcctgatgatctgtatttctaactcattatgaaaatgttccttagctttttgccaattgccttttgccccaaggagcacttctctgctttatactcttcatttgtgtaaacgaagcagtggtcttccactaatatgtctttgtgcaatttttcagttttattgtaggaggttttttttttttgagggaggaggcatagaaacaatgtaaaaaaccttgatgtttaatggtttaacaactaaagattattattataatatcctgctcccaataaaaattttcaaaattagaagttagctttcgctttaaaaatataaattttcggccgggcgcagtggctcacacctataatcccagcactttgggaggctgaggcgggtggatcacctgaggtcaggagttcgagaccaacctgaccaacatagagaaaccccgtctctactaaaaatacaaaccttatctgggcatagaggtgcatgcctgtaatcccagctacttgggaggctgaggtgggagaatcgcttgaacccgggaggcggaggttgtggtgagccgagatcgtgccattgtactccagcctggacaacgagagcgaaactccatctcaaaaaaaaaaaaaaaaatccattttgcagtagaaattaagacttctatgtcccagactcagtatataaggtataatactaataaaatacagtgaaataaattttctaaaaagtacatacttttagtgaccttttaacatccagcattaataatttcaaatacagtgtgatccacaagttctcaatatactaaaagcaataaaaaatttctccattacaaattaaaatgatcatggtttctacgctttaagacatttatttttaaattaattatggtaagtgaacaaagccagactaaaggctatatactatactattccatttttatgacattctggaaaaggcagaaaaacagaaacagaaaccagattactggtttctggctgggggtagaggacaggactgactgtacacaagcaacacaagaacatctggggcaggggagaggtgacagaaccgatctatgtttctgttatgggcagtggttacatgactgaatgcactgtcaaaagtcacaacacgactgtacaccaaaaggaatcaatcttattgtaggttaaaaaaaaaaggtaaattaaatttattgcattaaaaaagagaattcaaaacattctaaaataagaagggtaaactctagtctccttttacaaagcagcaggtgggcagttaatacggcaacactgacacaggaatgagctagagaggtgggttcttgacagcggggggtgggggggatacagttaactcaaagtcaagttttcctttaaatgaggttaagattccagtggatgttaataacccactttgtttcttacttgctgcggccaccagcaggaccagactcagtctgtgtgggccttcatgtggtctgctttgagcaggggcctgcagtgctctgtgggctacggcccagtacccctacggggtcctgcgcacaattacttcatcaagtcctggctcaaacatatggttaccccacaatcttgggcaacagcttgctttctctttgcttgtatgattttggctcaaaactagtggtctcaacttttttcacattcaggtcacgctgtctgggatattggaagccagttcccagaaatgctcatgactatttgtataatatagtcttccccactaatagatttttgaaaatcagttgttgttttttttcccccctacagaaccaggacttttttgagaggttaactttgattaatttatccttacagaaacaagattaaaaaaacacagctttccaaaatcataattcacagttacaaaggaccacacgaaggcataagatgcatatatttactactctggtatagaaacattcatatgcatgactggatggacccctttccctctttttcacgcaggaaaaaaaatgagaggggaaaaaaagggttgccaaaggatacagagctaaaacgaaattcatctttattccaaacaaggtctgcatttagactttacaatttttggcaaactccttattttcaaaactgtggaagcacccttttcttctccttggtcaccgagtcacactacttctcctctggtccccagctgctgccctccacccttctcgctgcttcacccccctccctacacacacgcgggttgcacccacaattataggctgtccctgtctgcagccgttccacacatgcctgccaagttttctgtgtaaaactctgcattatgtatactacattctgcacaaaatgtcagtggcttgctgttctaaggcaaaatcccatttacatttttaaaagagaattctaaatttaaagtctttgaacagcaatgtcaaacttgcatatatgaagccaggaaaataacctgtgagttgagcaagtgtaacaacaggaattgttaggccacagcaatttaagcatatgccctgttcacagccttcaaatgcaagttaataatcatcataaatatataataagattatacattttccaattatcataaaaaatctatacagctctatgaccccaggcccaattactttcacactttaggtatatatggaaggtaccaagattttgtttctaaaagactttcactaagccccagttctgtcatctgtaaatagggttaataatactacttaccttacaaaactgttgttaaggaataaataaaacaattaatgtgaagtgcctgccatatccctgcacatggtaaatgcttaacagatactggatatttttaaaacaactatactcaccaattgcctttattgtggcccctagaaagctccagtcaattgtaaaactcaacacattttcaacctcttcattgggtatttcctctacacctaaagagtgacaaagtttgtcaaccctatgtcctaaccagatgtcaaatctgtaccttcactatcactgccttagttgagtctctcatcaatttttgccagggtcagcatgtcagtgataaatatttactgactgggattcattgtgaaaggcagatcaaactcaccagatcaggaggagtggcagaaacggctagggacaggcttgcattctcagcagagagaaagcaatatgcaaaggcatgccacccacccccaccaaggaattcacctattagagaagtctgtctgttagcacgaacaaatcctggatacccgaaggagagggagttagacaaggaggcaaggaccaggctgagctgggtcatggtcttgtgcactggacacagactttttttggtaaccaatggaagccacagaagaattcttagaggatggtggaaagattgcatctgtgttttacaacaatcactcaggtgtaatgtgcttaaaatgtactcttgtgtaatggcgggggggtaccaaggcagcagataacttccaaccccttcgaagttaaaaacctcattatggagtcaagatttacatagagagatgtattgaacaagcagtagaatgataaaatttaaattactgaaaaagtataagaagaatcatagctgttagggatcaatgtgtcatagatacatgttaggagagacctaagtaagaagtgggccacaggggttactaaggacgtgcagagaagagagaggacattctaggtagaataaactgtttaaactattttgaaccaaatcccagctaagcatcataataattagagactctcatcttgctaaatctttagggacagggaaatagaagacagtcagcattataacagtattcctggaactcactaaacgtaaagcgggccaacattacagaaatagtgaagggcaactaaaaagaaaaaactgaaagacaagtactctagatgaccttatatttttaaaatccctcaaaattatctccatagcttaagccacaggccacactgaaagccgagatgcaatctcttcttcaggggcaagagttcaaacttttagctttaagtaagtcactaaagggctcctggtatgtcattttgctgttccattagactggaggaggcgcagggcttgcttagacaacagctttacctttggacttgttaatagatacgtgtcagactcccttagatgcaaactggatctctgcaccccagcgactccaataaagacagagatctgcgtgttgagattggctatcagccccctactccatcatcactttttctcactcccattggttctttctttcttgctagtatccttttcaactactcccggttcctgttgtcccttccaattcattactgttacaaaaaggaaactgatcaactaaaaaggtaattgtggctcccgcaccatcatgatattaactcacttgatccttagagcaatcctatgaagtaggtacgttatcaccctcattttatagatgataaaacaggtactgtttatcatctatagtaaagtaatgtgacccaagtcactcagcaagaatggcagagtcaggatttaaacttgggctatctgattctagaggttatctacttaggcaaatgtaattctgcctctcatactgaaatgctactttatccttctaaagaataaagaatccctagttctaattaaaaattataaagtagaacacaaacaaattcttgctattatattgtggtatgttctaaacccaggccaataaaaaatccagtgatcatgtcattataccacacagttgctagcaactaaaacagagtggctggccaactcacatgatggcctcaactccagaaagatgcttcagaatcaataatctctctttacaacaattagcatcttttcaaaaggacttatccccatgtcaaaagttaggagatggccgggcgtgttggctcacacctgtaatcccagcactttgggaggctgaggcgggcagatcacctgaagtcaggagttcaagatcagtctggccaacacagcgaaaccccatctctactaaaaatacaaaaaattagccaggcgtggtggtgcacacctgtattcccagctactcgggaggctaggacaggagaatcacttgaatccaggaggtggaggctgcaatgagccaagatcatgccactgcactccagcctgggcaacagaatgagactttgtcttaaaaaataggggaccaggagaactaatgagatcagtctgtcacttattagctaagtaatcgatggaaaaattcctataacctaatggattttaactattattttttataatataaaatacggggataataagaatatttacactatctacactaactgaagactactggtcagatgatatatatgtgaaagcattttggaatctgataaacaaaacacaaaaatcattctattttattgttacttaaggtataatcaattctcaataaggactgtttcagaaacagggaaacacatctatgcccttcatctaaatcaattttaatgccataagcaaatgagtaattacctgggataaataccaagagaagatgattcagagaactttcagaaccttgtggaaatacagttctgtttctgggaatgaacaatgtacagctcagtccagtatcaaagagttattgatgtatctcaatgcagtttaagacacatgtaaatggaaagagttgggacaaaataaatatagtaatgggaatgtataaataaatctaagcattatcattcgtaattttgagcctttttaggtgactcaagagactgtataataagcttagtacggatgtcacgggaagctggacagaaggaaaaccagaacctaggcctcacgcacagagcatgcacctgtgcttactcaatgcagcaaaaaacacaagtgtttcaagggatccaccataaaagggactgccacacatctaaaaagcatgtatatatctcccttctctttaaggtttttttgtattgttagtgatcacttaatttacttaatggttaactaaaacagtatttcacttatagactacatacattcctaaagtcatatgaggctaaacattctcctattttcaagctatcacagtttctattagcatctcagaattactctcatttcattattttctagtttattctattacaacacaaagagggcaaaagaggtaaatggcgaaagggggagaaatgcctcaatcatcaccctggcaacagcaggttcataacccactatgtgtatgtacctcaaccaaggcccaaggaacagttcatatgtttctggggaagaaaaatgcaagtaaggcctggcatggtggctcatgactgtaacctcaacactttgggaggccaaggtgggaggatcgcttgagctcaggagtttgagaccagcctggataacaaggcaagaccccatctctattaaaaaaaaataagaaaattaggtatggtggctcatgcctgtaatcccagatactcaggaggctgaagtgggaggatttcttgaggccaggagttggaggcctcattgagagctgtgattatgccactgtactccagcctgggtggcaaagcaagactgtctcaaaaaaccaatcaaccaaccaaccaaccaaccaaacaaacacccaagtaaatgttcttgagaccacatgccacatttatacatgtgtgtgtatgtatgtatgtatgtgtgcgtgttacatatatatataaaacaccattttttttccaactcaatagggacaaatttttgtgttgtgaatcacttaacaatagctttgtaagttattttcttgactattttgctattcttggcagtcacaggtcctgggagctattgcttgctgggcatttactaaggtcaggtgctctgcatacacatcctcatttgaccttcaggacagccccggagggaaggcgtggtaacctccattttacagatgaggaagggatcagtgagggtggggaacaagtctaaagtacagctctactaagcagcagagctggatctgaatccaggtttgcctgattctaaagccctctctattaatcctcatgtatttctattaattaatttttaatccccaaatatcaaactgaactttgaaattcttagtttctactgtttcttcagagtcctcagaaagctactagatgcagacacacaatctaaaaacacgtgattatggctagatactataggaattatccaaatgcatgtgcttatcaaacttcaaatctaataataaagaataattctttaaaccatcatataaagtccacaatttcgggcaagaaaggtcttacattgatattttctaattgtagtagatgtactgtataatacgacttcacatcttctgacaagagcttcacactgaatcctgtttctttaaacagcatctcttggtcatctgttggccagtactgtgcacatttaacctaaatttagaaatatgtatatgatttttttttagtttatagacatcatgaaaccataaagttaaaaaatgaaaacaaaccagatatatacatgctatattttttcaagtacccaaaactaagaagtcactactatattctacgcttaatgtattttagtaagattgaaattttatagccgggcgcggtgactcacgcctgtaatcccaacaatttgggaggctgaggcgggaggatcacctgagatcaggagttcgagaccaacctggctaatatggtgaaaccctgtctctactaaaaatacaaaaactagctaggcgcgatggcgggcgcctgtaatcccagctacttgtgagagtgaggcaggagaatcgcttgaacccaggaggtggaggttgcagtgagccaagatcattccactgcactccagtctgggtgacagagcaagactccatctcggggagcagggcgggtagagattgaaattttataaagcattttttatgtgtgtgcagtcatcactgtaagccagttttagaacatttctctcagactcagaaatccccttgtgtcctattcccactccaagccacaggcaagcactgatccattttctgtctccataggcttttcttttcttttgagctggagtcttgctctgtcgcccaggctggaatgcagtggcgtgatgttggctcactgcaacctctgcctcctgggttcaagcaattctcctgcctcagccttctgagcagctgggattacaggcgtctgccaccacacccagctaatttttgtatttttagtagagacagggttttgccatgttggccaggctggtcttgaactcctgacctcaagtgaaccaccaacctcagcctcccaaagtgctgggattacaggcgtgagccaccatgtccggtcttataaggtattttttaagtgttcctgtaacttataaactaaaaaagccataggtatcatattcataaaataaaaataaatttatcattcttaaagcatgattacctatattttaacgtcatgggacattcactttatgtttctaaaattatcaaactcttgcaataattttatcttcaaaataaatgttgctggccaagcgcggtggctcacgcctgtaatcccagcactttgggaggctgaggcaggcggatcatgaggtcaggagatcgagaccatcctggctaacacagtgaaaccccgtctctactaaaaatacaacaaattagccgggtgtggtggtggacgcctgtagcctcagctatttgggaggctgaggcagaagaatggcgtgaacctgggaggcggagcttgcagtgagtcgagatagcagcactgcactccagcctgggcgacagagcgagactccgtctcaaaaaaaaaaaaaaataataataataataatgccttaagaggaaaataaataattttttttttttttaagagacagtgtcttgctctgtagtagcccaggctggagtgcactggggtgaacttggctcacttcagcctcaatcttctgggctcaagcaatcccccaaccccagctgggactccaggtgcgtgccaccacacctggctactttttgtattttttgtagaggcagggtctcactttgttgtcgaggctggttttgaattcctgggctcaagtgaccctcctgcctcagcctcccaaagtgctgggattataggtgtaagccctccaacctggccagaaaaaaaaaaattttttttaagtaaaatagaaataaagagataaacaggattaaagagaacgtgacaaataaaaaaggtaggcaaagaaaatccaacatacgtataataggaagacccaaagaagaacattaaagcaagcaagggagcagaacaaatactaaggactgtaattcaacaaatatttctttaacaaaaagtatttaaaaaattttaaaaagtacttgaagtcaaactctcaagaacacatcatgtacctgtaaaaactgacccagaatggccaattactaagacatatttttggtaaaactaataatatctgaagaaaaagaaaaaaagaattctttgggtagtgcagataaaaagaacaagagacttataaaggaaataagatgtccattagactttggtggaataccagaaggaaatggaaaaaaaaagttgttcaaagaatagcacatgagccaaggattttatatcccgccaaactgactttcagatattaagacagcagatgaaccatcactgacatgtaaaaaaatcagactataatgctcacaagtccctccttaggagccactagagaatgagctttagtcagaatgactggagagacatcagcaaagactgttgatgaatattaaataatgcttgcttgtagaactaagagtctacaagagatgtaagggagagactacagtttgtaaagtacaactcagaaacaccaggaagagaatgaaaaaaatattaaaaattgtaaaccattttcagtaattattttggtagcagatgatatcatgattatggttatatattgtatatgatatgggaagaaggaaatgagtcattacaagatagtttacatctctcatatctttgagaaccaggattcttggtatgaaaaaggaaatagcagatgtaagatggaaggggctaagcaacacttatagttccaaatttgaactgggaatatcattatgaactcttgaagtatgttatcttaacatatgcatattgttccttagcttttgtccactgaaaagccctaaaaacaatgaccagtccagttgcaatatatatccttatttttgctgtgatcttgaaatactgctgcccattaaaagaaaccaaaactccttagagaaatggctggttccaggtctgggcagcaagagtttgagatgagcctgagatgcagtcattacagacagcaaaaaaaattttttttttttgagacagggtctcgctctgtccccaggctggagtgcagtggcacgaccatagctaactgtagccttgacttcctggcctcaagtgatcctcctgcctcagtaccccaggtagctgggactacaggcatgcgccaccacacccagctaatttttgtattttttgtagagacagagtttcaccatgttgcccaggctggtctcaaactcctgggctcaagcgatccacccaactcagctccccaaagtgctgagattacaggtgtgagccactgcacccagccaaggaaactattaaaggtttgttaaaaaggactcagagctgggtgaggtggctcacgcctgtaatcccagcactttgggaggccgaggtgggcgtatcacttgaggtcaggaacttgagaccagcctggccaacatggtaaaaccatctctacaaaaactagctgggcatggtggtgggtgcttgtaatcccagttgctcgggaggctgagacgggagaatctcttgaacccgggaagtggaggctgcagtgagctgaaatcatgccactgcactccagcctgggcaacaggcgagactctgtctccaaaaaaaaaaaaaaaaaaagaggactcaggacccaacctaaagacattgctgctagccaatgacagggtaatttgatcaaaaataaggaaaataactgcaaaggagtaaaattaatccagtatgtccaaacccataataattcaacctctcctgccactctccaccagaaaaactcctaattggtcatctgttgagaacagatgacctcaatagggaatcaacttttttttggaaaactgcttttaagagaagtaatgacagaattggattatcatcatttgtaacccataatgaattaagaagctgaacactgaccaataatggctattaatgaaataaaaagaacaataatcagacattatgggtctcttgatgaataacacattacccaccacctctgaagtaatcttccccaaaataattaaacctgactcttgttaaccatctaggttcaaccaccataaacatgatttctaaattctggtggcagtgttatcttattaatacagtaattatactccaaaatgagagaaataaaatttgcaaatcatgtagtctacaatggtgctcaaactgacaatgtcataatccttgatttttttttttttcttttttgagatggagtctcactctaccgcccaggctgcagtgcagtgggttttgagatggagtctcattctatcatccaggttgaggtgcagtggcacaatctcggctcactgcaacctccacctcctaggttcaagcggttctcctgcctcagcctcccaagtagctagcattacacctggctaattttgtatttttagtagagacggggtttcaccatgttggccaggctggtctcaaactcctgacctcaagtgatctgcctgcctcggcctcccaaagtgctgggattacaggtttgaggcaccgtgcctggcctaatccttaatttttaaatgatattgaagatcaggaaaaacccctgtaaatgactatgctgatactgctggaaattctggcatgtcattgccacatctaattagaagtggattaggaaattttcatcatcattaaaaaccagcaattatgaaatgtagaataaagtaagaaatctgaagtagaacagtacaagatcttaaagctggaagaggacttattgacaataggtcaataaggattcctagggattccaaagatctatatgtcactgctagtccatatttattccattgtatttctatcttggagatgaaaggtctgcaattgttataaaaatacttaagaaaggaaaaggatacatgagtttttccggacagaaacactttgaccgctagcctttagcaattaaaggccaaaactaaggaatgaatattggccccaaaatgaaaatctttatatgctaatgatcacatacagtatactaagttgtaaatattaaatattactcaccgattctttctccacaatgcggttcagcatgacaactgctttggtcttctgctgccaaaccataagccagaaatggcagcatgtgttaggaagtggaccctgtgaagagagaggagagagagcagatgagggaagcagacagaaagagcaaggctccaggaaggccttgttaagtctgctcctgggatgttacaagacagacagcggacgggcttataagaagtaaaccaagacttccaatctacctgatttcaaaaacaggtctgtgttagttaggatttttggttgtaaatgatcaaaactgacttttattttctcaggcaaaaaaggaattgtgtaagatatcaagtggctttcagagttgaggactagagagacaaacttgggtaggaaccaagggttaagacacaagcaaggtcctgccccaaagaaagtcaacctgggatgctgctcttgataccgtcactactatctccttgcttttgctggcactgccatatgaaggtggctatagtattcatgtacaatctataggcaaatcagagacaaaatcacgagtaggagtatctgactgatcatgttctagctgcaaagaaggtagaccaaggaaatttctgtcctcttcatcttctacagccaagaggatgtgcctcccacacatcatagaaaatccatgagaaaaaagtctgtaccatcactggccagccaaccaactcaagtcaactacaaaaagatttctagaaaaagtaggaatcattaaagtacctgaaccacaatgaaactgttaatctacaaatgcacagtatgtacggcctcaatggaagagtattgggcagagttaaaaaggggcaacagtccatgttacaacaatgccatggggataaaagcaaaatatttcatgtatttccaattgctttcacattttaatgatagcatagggcaaaaggaagatctaataagagatgaaaagcctatgtacaaattttaacgagttttaaatgagaaggttaaaatgagatgtagttttgctacacctaaaataactatgaacatgcattcaactcacatggaatgtagcagagtggtatgagttaggggcagagtcaggagtgggggctagggctgcccagagcttcagacccacatacaacaagggggttaaagtggttctagactaaaagcattttttattttttgagatggtgtctctgtcacccgggctagagtgcagtgtcacgatctcagctcactgcaacctccacttcccaggttcaagagattctcctgcctaagcctcccacggagctggaattataggcacccgccaccacacctggctaaattttggatttttagtagagacagggtttcaccatgttggccaggttggtctcgaactcctgacctcaagtgatccacctgcctcagcctcccaaagtgctgggattacaggtatcagccatggtgcccagctgactaaaagcatctttaggcctggtgtactccttggtatgtagcagatactcaataaatattacttaaatgaataaaccaaggttaagttgtaaaaatgctagaagtctactgaggatcctgacaaactacaacctaatatttgagagtggcgttttcctcactcaacttatttttctattacttgatctacttctaaaacaaaacacagtctaaaggtaaaaacagcaatgaggaaatccccagtaaaatgaatacctttttctttaattaggaaaaaaaaaatggatgtagcaatttgccagtgaggttactccttagtgtatacacacaatcacaacccatgccattccactggtgattctaaagactaaataataaacaggaacacagctggagtcttgctctgttgcccaggctggagtgcaatggcacgacctcggctcactgcaacctctgcctcctggattcaagcaattctccctccctcagcctcctgagtagttgggattacaggcgtgcaccaccatgccaggctgatttttgtatttttagtagagacggggttttaccatgttggccaggctggtctcaaactcctgacctcaggtgatctgcctgcctcagcctccccaagtgctgggattacaggcgttgagccactacgcccagccataggtttttaaatcagaggaacagagattcacatctcagctcttccatttaccagcaatgctaccaatgttcttcatctgcaaaacagacataatacaccaaggaggtgacttttaaaaaaatactaattcataaaactcagaagaaaaagatgactgaagtaacaatctacaaaggacaatcagaagagctgggttactgcatctctagttttctgtatcctccattccaaacaacctgctagatgcaaggccaagagctagactgagatgcagtcttggctctttaagagcttgcaaaggtagaaggagaagtacttgtatgactaatggacacagttaagtagtacaagagtatgggcaaattaaaccatcaggtcttagggagcaggaaaggctgggaaggaaactacagaagagcctcgaaaaaggtcctaatacagagagggaatgcagaagaatgggagggagttagggtccactccaggccctccaagcataaggcaaagtgcatgaaagtttagggcatatttgggaaaagacaaatagatcagtgaggtagaagtggagggatgtagttggtgactacaccactagagtgacagggatggtgccaaggggagaccttaaaaagctgctgcaacaggacaggtgtaattgaagagagctctgaaaaaagcgaggggcaatagaagatcagaaagaacttggcagacaatgaggacagtctcaatcccaatgagaaaaataggaaggcagctaccttggtaaaaaagacagagaacatgcagactttgaaatccagtaaaaatatccaatagagacctgaaaaacatagagaggaattcaggagagaagaaaaagccagacacaggcttctgagttctcgcattaaatgggcagggctccttcaggacacacacagcgacaagaagttcaaaaacaattactaggaggctgggcacggtggctcacccctgtaatcccagcactttgggaggccaagacaggtggatcatctgaggccaggagtttgagaccagcctgagcaacatggtgaaaccttgtctctactaaaaatacagaaattagctgggagtggtggtgagcacctgtaatcccagctacttgggaggctgaagcacgagaatcacttgaacccgggaggaggaggttgtagtgagctgagattgcatcactgcactccaggctgggcaacagagtgagactccatctcaaaaaaaaaaaaaaagaaagttatttaatgtctctggatctccttagattcctcgtgtataaaataaaggtaatactatttaccacagagggttgtcctaaggtttaaattatacaaagcatgtaaaaacaccattacaaaatttttaactgttattatttcctattataatgtaaaattcataaaattcataatagggtttttatgaaagtctgttttatttaaacaatgcctgccacagagtaggtctcagtaagtctttgctgggtgagtgaatacccagtgaaatgctggcaccaagattccagcacaggtaccatgacagtagtctaccctatcttaggttacaaaggttgaaaaccatggtcttaaagggctgtagtgcagactggaggagaaaaaaaaaagctaatttagaatcttaagacctatgtttttaagaactaagaagagaacaaaaaaccagtaagtgataatggagaagaacagtacagagggagaaagggttgtgataagggatctagggtggtaattcttctctattttttaatgtaattagttgtccctcaatatacacaagggactggctccaggacccaacctgccccccacccactgcagtataccaaaatccacacatgtccaagccccactggtggccctgtagaacctgcagatacaaagagtcagccctctgtatgcatggatttcacatcccatgaataccgtatttccgacccgtttttggttgaaaaaaatttgcctgtaagtggactagtacagttcaaccctggatggttcaagggtcaactataggtatttcaaacagaaaataaaatttttaactctaaatagtagtttaaaatacaaatgcacataaaaaaaacttccaatattacagaaaggaataaaatggaaaattaaagtctctattcccaagctccacaaattattactaatggtatatgtatgattaacttatttaaccagtcccttacagattgcttgagtctgatgcgttaaaataagactgcaatgaacatgatcacatatgtcttttttttttttttggacagttttgctctttcgctcaggctggagtgcagtggcactatcttgcctcactgccacctccacctcccgggttcaagcgattctcctgcctcagactcctgggtagctgggattataggtacccgccaccatgcccagctaatttttgtatttttagtagagatggggtttcaccgtgttggccaggctggtctcaaactcctgatctcaggtgatccatctgcctcagcctcccaaagtgctgggattacaggtgtgagcctccgcgcctggccgatcacatatatctttatgtctgactgtatttctctaagtagactttcttggtcggtcagagtatttgaacactgagtattatacactttgaaatctctccttttctgacaggtgaaaggcccattccctggttactgaatggagcatttcttcatgtgcaaagtgtccacctttgattctttgaactaggagtttatgtcctttgccagttttttccatgggctgttttttttctttttgacttgcaggagctgtactacctcaagtaaaaaatgcattttagtttcctgtgaattgacgtagtataatagctcatagttacattaatctgcatatctttttacttatcaaatatttttctctttcaaataagtcattctgatttaagttatgttttcaaaaatctcaaatattatggtatatcttttgaatatttaaaaatctttagggggaaagacagccctgttgataatcaagtctttattacttgatgaataaagagtagctgtggatacacaaaaatctctcctactatctcagaatggaaggaagaatcatgcttgcacacaggtgtggctgatgcgctcagaggcaactgggcagaaggccacagggagcacaaggccttgtggctgggcctctggagcacctggtctcagcacccgctcaggtccttgaagacgaccagacaccatccagggcttggtgtactctctgaagatatatgcgaggcagggggagctacagaagagctgtccagggcctctggttttgccacagggtatgggaagagaaaagaagacactaagaagcataagcagcactctgtgtcagatataatgtaaggaacacaatctgccaaagaactggcctaagccatttcctaagaattttccttcacagaacgtgtaatatcaaaaataacttgccttttatcttaaatactcaaagcttcaaaaccttataatgtccataattcattacatcgtcagaaaaaaactgaaataccatttcatttccaaaagaagtcaagatatacttttacctatgatttaaagcagaacaagcacaaacacatcattttcagacatttgcgtggtatcgtattacttgcctgtgttaagatgtaactcctttgtgcctcttctatgtcaactaaactggcattaatataatcattctcagcattttgcagtttaacacgactgtgatcatctgaaaatagagaatgataaaccacaactgtcatttcaaaattactgtttttatcttcatattaatattctaggtatttataaaaagacagaagaaataagaaaaatgaattagcatcataatagagttgagacaaatcctaaactattctctactttttttgtaaggagtataaaatgcaatcttgtttattactatagtgctggaaaggaagcacttctgtttgtagcacattagccattgtgacttgaaaaatcgaccaggagtaaacatagttaaatgaataaagtacttaccttcctaaaagtaaaaggatcattcagattcttggtacctaagaattgattggtctacctacaaaacgataactggtctcaaatagatgagactagatttccgaggttactatatttcaacctcttcatttctcaacagataagaattccactatatttaaataaattttagcactgaactgtgtttaggttaaatgctgaaaatatttaaagacagttggaatattccaactgtattctttaaaagaccactgaagatacttcactacttagactctgttaacagtttagagatatttctagtttttaaaagtaaaaatctcatagattgagaatttatgctaatttaaatatgtgaaatacaaaatgtgaccttatacatttagatgggaaagcaagagaagcatgacaccaggagaaaaagcccatgaattaactcagaatcctcaacacacaactgccggatgcatatcactgaattataaaactaaaaacatggtgtttgatgtttaactctagagaatgcatactattacaagttgtccctctcaaagaaatccatactaaatagccagtctctccttacttttaaatgaaaaaactgtttatattatctccatatgaaagaaaatgtaaaatggctttagtttcacacatcaatttatctgagatgtttctgctggactgaacccaagacctctgtaaatattacatgtcatttgccaacaggaaaaactaagatcttgttatagtaaatcacatatactagtgttctcagaaagatgatgtcaacaagcacttttttttaaaaatcacttttttaaaaaacagtttaatcaccctttaactgttatattatgtaaaatagtaaaaaggtcagcaacttaattaaaataaagaccacatatctcctagacaacataccaaaaaaagaaagcctggttttagaaaactacatgattttaaaattaaagttccactaaaatatcacaccaaaggaatgtatttcctcatgttgtaatcacagaaagaacactaaccaaaggctactcatatctattgcacaactgaaaacagccatttagctaacatgcggtaggaatccataaaacccgggaaggtccacctcacagggtgctgggaatctggttaccccacatggcaccaccccacacccttgcccagctatgcaggaagtaaacctagagaaagaccttcagccagagtatttgatacctcaccctcaggactctgaactaaaattcactgctattttccttctatctgtaaaatatgcacgaggtgttacctcaatgctctataagcacagtaaccacacaccagaaaagcccagatccagtcctgggaggcagtagggaggagggcactacctgcagggcactgggtctgcagggctcagcccctggcagtggcctcgcttcctgtttaacattaatatacagagtcaacaaaagcaaaggaacggtgaattttctcaggaaaatttttttttattttgttatcagataatactaaaaaagaaaggtaatccttgggaaaactctatagctatttagaactgactacaaatgttatttgagcctgtattttcttctcaaggctgattaaaaacaaaactgaaatacctacatcactagatattattttaattcttctgttcttttaagaaaaacacatacaaaggaaaaatgaaaaacaatttaaaaaggaagaaatattaaagcaaaaaggagaaataaaactttaaaataaatttaaaatacattaaaattataaaaacaaaaattgaaaaagattaatataaaataaaaagtatatataactttttgatttcgaagaggcagtagagaaaaaaataaaacacatcaccttaaaataactattgcaaaagattgtgaatatacacatttcaggaagtgaaactatcaaagcctctttatgagaaactgtgactttataatttatactctttagtgatgataacaaagaagggcactacctcttctccaattaaggatcacaacacacggtttcgagtttgtgagagcatatacacaggttcccttaacaacctgagtcacaggtctcttttccctgcccagatactatcagtcagccccaaatctgtaaactaatcattaaaaaacaaacttttgacttctgaatgagaacacacagaaaggtacatcctttctcctcttccataggaacctctgacatgagattatcataacagcagcatcccataacctttgggctgtataagtaagccccaaagcccactatactttaccatccttgtaagtctggttatctcaccctttcctcttttaaaggatccagtaaagggagaaaaatgaagatagttcaaactcttttgcatgggataccacaaaagcaaccaaaccacacttcacaggaaatcttatttctcaacctctactagcactagtagcagaactatcaagaacatacacttttttttctacaggcatcatctgccttaattcttgtcactgagtaaatgaagaaatgcaatacccaaacagaactgtggtttataacttggattaaaattaagccaatttctgacaaggagtcccttcacctcctaccctcaaacagcatgttttctgagaaacagctccacctctcaagaaatgactagtgctagctgtggctgtgctgacaatacagattagtttcctctttcaatactgtcatcataagctttaaaaaaaaaaaaacaacccacagctttcaccaaatatatcattattgtaaagacatctccttttggaaagttttccaggtcaaacagaaaggagaatttgtattcattgtaactggttacaattcatcctgaacaggttaaatcacagcaaagatcaagcatccttaacttacaagtcaggcaagaagatgaccaattctaatagtacagcgtgaaccagtgacttttcccctttagattttcccattctcaactaagggtaatcagtacgttttcaaacagtgatgtccaagaactcaaagcattttctagatttgtcaactctcttcaatcctgcaagtaaaatagtcgaacaacaaatattatgcattctctctcataaatcgagcaatgaaccaaaaacaaagctggcactaaacaccaggtcaccatatactcccccatattaatggagaatacaaactttagtacacatagaatattaacatttcaattgtttgctctgcaaagaaaattctacttgatgaaaggtttccaattgaccacaaaaccaaccagaaccactgtctagaaccatttggtgcctacgacatgtcaggtttgtgtgacactcgtcactgggtcacctctctcagtcctcacagccctatgaagtgcatatgaatatggatcacacccatcgcactgtcactcagggaagtcaagtcatcacaagtgtaacacactagagcacaaaaatgaaacctagatttgtgcaatttaagagattacctatttcctgcattctgcattccatgtctccctgatccatccagttggtgcctttaccatcctttccatacatcctaaattcttgctgacatcaccttttcacgttgctctccactcaggtgtgacttccaactcctctctcacataaaccccacttctgtgccgatgcagtccatgacatatcttctctaactagacgctctgatggaatgcctccatgatgaactggtctgttccctgcattgaatactttcagcaatcatacacaatttttagtcaacaaacatattttaacctatagggatctaaaggtaagacattatttgtttgaagcttttaaaaaggaaaaaagaaattatattaagccgtgactctgagtactgatactttattgcataaaatattgtgggaaggagcttgagtagttgctacctgaataggcctagtgagatcagcaggaaggggaaattccagcagagggcacatcataaagaggaatgaaagggaatggtgtagcggcaggactggcagattcagaaaggctggcgagctggctagagagggctccccagacacattaagggcggaccctgaagggcacgtgggccgtgctacaggcacaggctctggacagggccccagtgaagttctttaaaggactggtataaacacatttgattttcatgaaaataactctcagcagcatagaagatggactgaaccaagaagaaggcaacttcatacaccaatacactgaaagcgtaatcaaaaggtgatgaggcctgaatcaagtagtggcggtgggaatgtaaagagtatttccaaggtagcaccatcacagctttgctaataaagtatacattgtttaggaaacatttggtaagttcaaccttttccaaacaatagtttactgtccttgaaatcatcagcgtctttcaacccatcatgatttcaagatcctaaacttgacaggacaatgtcactaattaaattctgattccacaaatctcctaattgaaaaagtcctctttaatctgtccccaagagtctgcaatgaaaagaatacctgagaaatgtctttacaaaataggtaaaattcattagtttggaaaacagacatttttcctctttggtagcttgtataaaataagacatactaatcttcactttaaaataatcagtaagtatctcaccatttttttttttttttgagatggagtttcgctcttgttgcccaggctggagtgcaatggtgcgatctcagttcaccacaacctccacctcctgggttcaagcaattctcctgcctcagcctcctgagtagctgggattacaggcatgtgccaccacgcccagctaattttgtatttttagcagagacggggtttctccatgttggtcaggctggtcttgaactctcgacctcaggtgatccacctgcctcggcctcccaaagtgttgggattacaggagtgagccacggcgctcagcagtattgcaccattttctttgaaactcagactctccgcttctaggagagttagagcctaaacaaattgaaggtggagggacttaggggaaaagatttaactttcatcacatccaaaggcccatgagacaccatgcaaacaatgcggaccaaatatctatattggtgatatagcaataagcataactaagtaaagtatatgagtaataaatgctaagaaaaaagagtaacgggactcacagcgctggggagaggggcaggttgcaattctaaacagggtggtcaggatgggccttgtggctgaccacccaggtgggtcacatgtaagcacagatgtggaaggggtcagtctcacggatattttagttaacagtgttccaagcacagagaacggcgaatgacttaaggtggtacatacctaacatgtctgagggacatgaagaatgtggctggagccacggggacaaagcggagaggagcagtctgcagtttaggttcggagagtcaagaaatcctgtactgattcatttctcctaaatttgactgtcagggaaaaaggactgctacttccattttctcagcgggcctacctagtagagtgtcataacaatttaagtcagcaagtattcaaacattgtttatatgatgaattccagaagattttcacatattcaaattcctacacctgctagaattttgttagaatgacaaatcactatcaacccattctgaaccataagcaggaaatgaaatgacgttaactgactttcttaagcgtaaactaattcggcagaaaggaaaagcgcagaaaccttcaggacttcttagtacaggtacctggaattttgcgacgcagatgaaaaacatgggtgaggggagtttgagggatctaaagatgtggattctgatctctcttttggctctaccaacctacatgattccagacgtagtcatgatttcccagaaaagggtgactactacttgagaaacactatcagcatcccagtcgccgacagtcctatgataaggggcactcaggggtctgttttcttgtctgtcaaaatcagtggctcgaatggaccagtccttcttgattattttcactgacaaaccctccttaataccctaagagggtattaaagtacaaaattccttggtaattcctattttaccttaaacatttaaaggaatttcagaattctacttgatcatgtatctgtattttaatctagaaacaaccacaccctcaccccaatcccgagtacagctgactgtcctggactccagcactcccccactgcacgcttccacagctccctccacccagcgtaagtgctctagggcagaccagcccacccaaggtgctgtggcttttaagaggggcctcttagggcaagattctgatcagctccgctggtggagggcagcaggagcacccaggcacccagtagcagccttcttgccacagttaagctctttgcagccagggacgctgtcagactcaccacagagccccactcctagcaatgcgctgtccagggcctagttccagaaggccatcaaactcagaagcatgaaaagacactgctacaatccacagaccttattttgatttctccagttctacaggcactcatttgtgtgtgctcagttctatgccattttaccacaaacaaattcacatgaccaaaacaacacatacctattccatcagcacaaaggttctgtgtgccccttggcaggcacactcttccccattccacccctaaccaccgatctgctctccctctcgagaattctcatcatttcaagaatgttatataaatggaatcatgtactatgtcatcattggaaactggattgttttcacccagcgtaagtcctctgagagctacccatgttgttacgtcaagtttcttcctttttattgctgagtagtattctgtgttatgaatataccatagttaaccacttacccactgaaggacatgtgggttgtttcgaatctggggctactacagataaagctgctgtgaatattcatgcacacacttttgtgtggacattatgactgcatttctctgggataaatgcccaggagtgcaagtgctgggtcatataagctaagtatacgttcagctttttaagaaactgccaaactattttccagagtggctataccagtttacattcccaccacccatatatgagatccagcttctctgcatttttagggtattgtgatctctttactttagctgttttagtaggcgtctagtgacatcccaccaccatgattttaatttgcattttcctaatggctaatgaagttttttatatgttcataggcttatctgccatctgtgtcatatcttttgcccatttcctaactggggtttttgtttctttttactgttacattttgagagttctatatatagtccagatctaagttctttgtcagatatgtggtttacattttctccaagtctgtactcatctttttgtcctcttaacagggtgttttgaggagcagaagttttttatttcgatttagtataaattattgatattttaaatgaattgtgctctaggtgtcatagctaagaactcttcatctagccttacatcctgaattttctcccattttcttatgaaagcttttacattatgatccatctatgatctatcttcagttaacttttgtgtaaggtgtgagatttcattttaaattgctttgcacctttgtcaaaaaatcagttcaccatatttttacaagtctatttctagattatgttccactgacttatgtatttatccctctgccactaccacactgttttgattactgtggttatgcattaagttttaaaactaggtagagtgattcttctagtttttattttccaagatcattttagccattttattttagttcctttgcctttccacataaaagaataagcttgtttttatctacaaaaaaacttcctgaaattctgacagaaattgtgttagatctttaggaacaatttgacactatgagtcactatagatctatagaacaatttggggaggactgattcactatgctaagtcttccaatccatgaacatggtaggcctttttcatttatttaggtcatcttttgatttcttttatccatgtgtttggtgctttcaacatacagatcctatatgtattttgttagatttattccaacatattccattttcttagagcaactgtaaacaacaatgtgtttttaatcttggtttccacgtgtttgttgttaatatacaggaatacaattggcttctgtatgctgaccttgtatcccacaacctcgtttaactcacttattagttctaggacattgttgggtagattctttgcaatcttctacatgtcatctgctaataaggtcatttttatttcttcccttccaacctgtatgccttttatttccttttcttgacttcatgtactggctaggattcagtacctcaagtttatatgtatttttaatttgtatgtttaaataattttaaaacttacagaaaaattccaagcacaaagaattttcttcccaagtcatgacagcaagttgcaaacatacctgattattccatttttttatcttctacaatgacataatcctacttactcatagtatagccatcgaaattataaaattaacagtgatactttactaacccagacaccattcaagttctaccaactgtcccaataatgtcctttaaacaaaaggatacaatctgttctttcacggtattttttaaccttttgaaactgtaagtcagttgttttatagtgttcctccatttgagttgtcagatatctatttccctatagatgagttcagtttgtatatttttggcatgttcatctcagaaagatgctaagtattcactgcatcttatcgggtggttcaggattctgacatggtatatctcatgactggtcatgaccacatatttaaggctggtgttggccagacttctccagtgtagaggtactattcctcttcttatatttaataagtattttgtaaagggatacttcaagattatgtaaataccttgttcttcaccaaattttcacccaccaactttagtatccatttcaatatttattagttggcaacctatacaaaggtagaactttccctatccctcatttatgtattcatttgtttctttacatcagtatagacacattaattcctattttattcaataggttgtaaccattatttattttcatgctcagattatcccaggtttggccagtggactcagcttggcttctacatccttctgatatgtcttcatcattttttgggcatgtctttatgttctgtcactacaagacattccaggctattcttacactttccctgtcgcagacgtggaaccagccatttctccaaagctctattctcctcctagtggagaataaaatttggtatcaaaagctaagcatgcccaatggctcatcagctatcgctgctctcaagatttcccagtggacagggataagaaatataggtatatacacatacctatgttcatatttatctgtgtatctatactcactgaaaaccatgcattcatacctggatacagcaatgctaacccaatattacaggcttctttttcaaggacattaccacctttactcacatgccttccacatgtgggcccaaccccaagtgctttatagatttaattattcagggacagagaaagagaaacttaatgatatctttaatactctctttactaccctatgacaaaactatgtacaagatttttgtcagtccaaaaaaaaaaaaagtttcatctgttaaggaattcacaatgtaataggacagaaaggtgaatgcgggaaattggtgagaaagagatgaacaggggcaagaaatgaagcatacaagaaatagaccaaagtaatctaatgcaaccctctataattcattcacaaatattctctagaagatctgacagtgagaagatccaccctctgcgtgaatacctccaataacaagtgtactagttcagagggttcgtttgtaggtttaaaacagctcttaagagctaatgctaacctgatattcaccagtgctattattcgctcatgaaccctagttctatattttgggcttaacacaggataaagaactcttttttccatgtaaaagttcaggtatctaaagtcagctatcatgctgctctgtttaggttttctctttccctgtctaatcaatgctagcttcttctctaagagttctagttcttcttccttggaaccactccagtgcatcaatagcccgcaggaataaattattaacatcataaatagctttgatttggctttgattaaaattaaagatttttttttttttttttgagagggagttttttttcgctcttgttgcccaggctggaatgcaatggcgcaatctcggctcactgtcacctccacctcccaggttcaaacaattctcctgcctcagcctcccaagtagctgggattacagatgccagccaccacgcccaactaattttgtatttttagtagagacggggtttcaccatgttgacctcaggtgatccacccacctctgcctcctaaagtgctgggattacaggcataagccactgcactaggccaaaactgaatatttaaaaaaaaaaaaaaaaaattgaagatagaactaaagaccctaacagtgagtgagaaaatcttttagtaaaaaagctgtcaacaacggattttgagaaggtaaagcactacactgacatctggtctttattttcaaactttaatgggataagaaaaaatgttagcaaatatttacataatagttaccataaaatttaacttaaatctatacttattcggattattattatagaactaagtttttatctaaatctgctattactaagaaagatgacaagcactttctggtaagtttaaaggtttctttttaatgatttgaaggtctatcatcttataattctaagactatcaaaatgtttcttaataattctttgacttgtctgcacatttctagaggggttatctacgaagcaattcgtatcatctatagtggtgatggttttaaaatatgtccacaattcactgatacttcctccatcaaactaataagagtattaagtaccctctccttgaacatgcatggccttagtgagttacttctcaaacggaatgttgtggaagttgtatgtgacttctaaggctaggtcacaaaaggcaatgaagcttctgccttgctctctaagaatgctcactcttgaaactcagttgccttgtgataaagtccaggtctcatagagatgccttgtgtaggtgttcctggtgacagcccagttgaggtcacagtcaacaagagtaaagaagttgcttcttcaaggtgactccagccccagcccccatttgaaatgcaattacacaaaagaccttgagcaagaatcacctatgtggggttagtcaacccctagatttgtgaacataataaatgtctcctattgttttaagccactgttttggggtggtttgttatatagcaacagataaaacttttatacttttattcctcttactgaaccttcctgctttggctatgaaagttctatagtggcctcataaacagattaaaagacagttaatttatttctttccaatccttatggcttttatttctcattcttgcttactgtactaactaggacctagagtataaggtcagggagacagaagtataatgttaagtataagtggtaagaatgaacacacttaccttgttcccaatatttttttaaaacaatgctttcatcatgtcatcattatgagtgatgttgttgcagttatctcttagaaatcttagaagttcccttctatttctagcttgctatgtgtcatttttaatcctcagcaaggactttaaataatctttccacacttattgagataatcatatggctctttctcctttgttactgtggtgaattataaaataatctaggccgggtgcagaagctcacgcctgtaatcccagcactttgggaggccgaggcagatggatcacctgaggtcaggagctcgagaccagcctgacaaacatggtgaaaccccatctctactgaaaatacaaaaattagccagacatggcggctaacgcctgtaatacaaactacttgggaggctgaggcaggagaattgcttgaacccgggaggtggaggttgcagtgagccaagatcgtgccaccgcactccagcctaagcaacaagagcgaaaccctgtctcaaaaaataaataaataaaaaataaaaaaggtattctaatgttagctacccttacattcctgaaataaacttaatgtgaacataatgtattatctttttaatacattgctatattcagtttgctaatcctttgttaggatttctacatctatattcacttgcattattatgaaacataccggtaaaaccagctggcccagtgttttctttgtggattttgtttattaatgtctttaagtggactcttcagactctacttctgcttgagtcagttttggtaaattatgtttttctaggaatctgttccattttttctaaaaaatcatatttactgccataaaattgttggcagtattcaattcacgctttctttgtatacctgtatttatgtgcccactctttctcctgatattgtttatatgcaccttctttctttcttgtttgattgatcgtgctcgatcttgacagagttgatcagtcttaccgaggctaacatttagtttagttggtcccttgtgctgtaactgtgatttctatttctgctcctttgttgttgttacttctttctgctttttttttctcattctcttatttttactctaaattaggttagacagcacattaattttaactttcatcttaaaatactgggctaggcacagtggctcatgcctgtaatcctagcactttggaaggccgaggcaggcagatcacttaaggtcaggagtttgagaccagcctggccaacacagtgaaactgtctctactaaaaaacacaaaattagccaggcctggtggcacgtgcctgtactcccagctactcgaggggctgaggcaggagaattgcttgaactcgagaggcagaggctgcagtgagctgagatcacacccctgcactccagcctaggcaacagagcaagactccatctaaaaaataataaataaaatataatataaatatttaagacaatatattttcattgcagtactgttttagctcctttacacaagttttgataagcagtattttatatattgtttatttttaagtttccattataattttgtcttgacccacgatttagaaatgttaaaacttccaaatttatggaaatgtttatctttttattaataacctatattttaattgcattaagataaaaaattatgagctataagataggaattttttttttttgagacagagtttcgctctcgttgcccaggctggagtgcagtggcacaatcttggctcaccgcaacctctgcctcccggattcaagcaattctcctgcctcagcctcctgagtagctgagattacaggcatgcaccactatgcctggctaatctttgtatttttagtagagacgaggtttctccatgttggtcaggctggtctcaaactcccgacctcaggtgatccacccacctaggcctcccaaagtgctgggattacaggcgtgagccacagcgcccagccaggcattcttaaattttaagatttacttgacagcctagtcaatggtccattttttacaaatagaccatgtcagtcctagaaaaatgtgcattttctaattgctggatatagggttctatgtatttttcttcttatattaaggttaataatattatataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaagaaaaaagaataatattatataaatctatttctttacaaatatcttgtcttattaagaagcccatgaacatggatttgtcaatttctccccaaaattctattcatttttgcttaatacatcttggggctactttattagctgcatacaaatctcagagctgatactgacatctgcattcaaagtagttatgccatttgctaagatcatgcagggagcgtgccgaaagcatagaagttttcccttccttcttccccctctagtaactcatttaaaaagtatgtttatttgagaatctttttgttttgtagagcaacaaaccatggactatgtaacctgacactaccagaatcatgagtctctgtgttaatttcctttaaaatctgactgtttcacatggatgaaccttgaagacagtatgtcaaatgaaataaaccagtcgcagaaagacaaatactgcatgattacacatatatttagtgtctaaagtaatcaaactcatagaaacagaaagcagaatgctggctgccaggggctgggggaagaggaagatagggagtttttcaatggatttagagtttcagttatacaagatggaaaagttccagaaatctattgtacaacaatgtgcatacagttaacaatactgttaatatacacctacaagaaatttatggtatgggtttttaacacacacacacacacacacacacacacacacacacacagattgtttcatggccagtgaaaagacatgacagttgactcaattgctggcactcccttttagaccaaatagtaaactgggatttctacctgtactgcaaataggaagatctcaaaatttggtggtagtctctaatagtataaagacgtttcccaaagtaaccattacaagctactctcttttcaaacaacgaagttcttgtccatctcttctacaatgtctcacagttaactgagacaactgaggcatctctaggttgtagcagattatggacctcttcaaatcctttcaattttcttccttttttgagacaaggtctcacattgctcaggctggagtgcagtggcacaatcacagctcactgtagtctcaaattcctgggctcaagcgatcctccctcctcggcctcccaaagcgttgggactacaatcatgagctgctgcacccagcccaaattcttcctaatttaaaatatcctttttcctttatgtttctcgtattcagaactccaaatgtagtttccatatgtcagtctgaggagtggtgccatagtgagtgtaaaagaatcatgttaagattgtttaaaaataaacatttccagaccggctgaatccaaatctagaaaagaaagatctgggactctgaatttttaaaaaattctttttccattcccctttatttacctagttcaggctaccattctttttcttaaaagccatccctgcctccttgggcagagcctcttctcagctccatcaatgcactgtcatatcttacaatatctgtaacatgcttatgtgttaatctcctcaagtataccataaattattcgatacatagcatagtatcaaacatgtagctggttttcaacaaatgttttctgaaccaaatcagcaactgtcaagtactatgtatagaaatgcatttaaaaaattttttagagacagtcttgctctgtcacccaagctggagtgcactggtgccattgcaactcactgcagctttgaattagtggtctcaagtgatcctcctgccccagcctcccaaatagctgggactacaggcatgcatcaccacgtcccagctaattaaaaaaaagttctgtgtagagatgttgcccaggctggtctcaaactcctggccttaagcaatcctcctacctcagctttccaaagtgttgggattataagcatgagccacagcacccagccagaaacacatttttaaattacataatgactatcagttggaaaaggtacagcaacaccatcccagcttttaaaaaatacacattcctgagcccctctggacttagtgaacgagaaccaccacctccactggatgagaataccactcacgggaaagaggttgttgagctggtatttgcagaaggagaactttgattgagatgggtcagagagaggaggggaagaatatttcaaaaagggaatgacatatttgaagccactgaggtattaaaaaccagtcacgctagaagaactccaagtgattcagttttactgaaatgaataatttctaggaaaatgggtagaaaagatttagagaggtgtgtaaaggggtcaatctccaaaaagcccagtatgataatgctaaagaagtttaactttttcataaaaattgtgcagcactattagagaggagagtggaaaacacacttgcattatacaaagattactccagataccatgaaaatggactgaagtgggaacagaagggaaacaaggagatgggtttggaggctactgtaatgacgaggaaaagcgtagtagggcctgaaccaagccaatgtgaacagagaagaaaacagatttgaaatacattacggaggctgagcacggtgcctcacacctgtaatcccaacacatcaggaggtcgaggcaggtggactacatgagtccaggagtttgagaccagcctgggcaacatgacgaaaccccatctctacaaaaaatctaaaaaactagctcagcatggtggcatgcacctgtagtcccagctactcaggaggctgaggtgggaggatcacctgagcctgggaggcggaggttgcagtgagccgagacggtgccactgcactccagcctgagtgacagagccagaccctgtcttgaaaaaaaaaaaaaaagaaaaaagaaaaagaaataggaatacatcatggaaatggaaattagtattagtgacgtgggaaatgaatgagggaagaatctgtttctggcttcagaaaatgtgtaaataacggcaccacttataaacatggggaaaaggagaaaaggcaggtgtggggctaaggccagtgaagtgtgtcagggaggaacactcactcagtgtatactgagtctgaggtggctacaggacacccagacagagatgatgacttggatacacagacctgtagacagaaaagtccacgactgcagatgagatttggggttataagcagagatggaaactaggcccacagcagatgagatcattcatccaagtgttacagtgagaaggagagagaaacagactcctgaagaaataaaggcaaagtgaggaggagacaccctgaaaataggggaggggccaaagaggaaaatcagaaaaattacggggttaggaaaaaaggcacggtcggctgggcacagtggctcacacttgtaatcctagtactttgagaggccgaggtgggccaatcacttgagatcaggagttcgagaccagcccagccaacatggtgaaaccctgtttctactaaaattacaaaaattagccaggcgtcatggctcgtgcctgtaatcccagctactcgggaggctgaagcaggagaataatgtcaaaagtcacagagaaggaaaccagtggaaagtctctcattgcatttgacaactacagctacagtgcttttagaataagtttcagtggggaggctggagaagaagcatgggctgaagtgtgcatggtggggagggtggagagacaaatggcacattgattcttttaagcctgtgtacaggtaagaaatgtccatccatgtaggtaagaaaggaagtgggggctggggtaggatataagggttgagacaaaagagagcgaaccatatttatacaaaagagaagaagttatgagatagaaagaggctgaaaacacacaaaaagcagtgatgatgaagagcagggcccatgaggaggatggggacgaaggattcggctaggacagagggaggggaggcttctctcctgggactttagggaaggataggggcaaaagaaagtgagtttccaggtgatagaacatgaagctaaggtggtgtttcctgatttttacaatttttatctgtagaattgaaagcaggacgatatcctgagcatggtgaggagctctgagagataatttactcggtgcagagctggaacacggtggcagtggggcagacgagggcatgaggacagcaaggcaaccccaagcccacctaacactggagtccacccaaggcacacgctcatttgcccaaagtgcagagaggatgaatgactgatttttcctaagttggagcttcacaaaatggtggaattaaaaaatccagagttattttttaaatataaaaacaacaagaaagttattaatagttaggttagaggacaaagtaatatgcttcactacattttttaatcgaaatttcaattcaatacatttccaacttcacaatacatgaaaaagtcaactaaagatcctgctgaagtcaaagagcaggtacagtgggagtaagcaagtgaaagctggaatgacagaaagtagccctcaaggcagcagagtttcagatttcagaggtgaagatgactaaaggtcaatgtcagcggagctgaacaggtctaggaactctagcgcaatgagccgtagttctttcccagagacatgaagtcacccaggatgaggaaggtgggaaggagagggtaaggagaaagacagtgaatgactgaagtcaggagaggagaggtgccaaggcggtgtggggatgtgctggccagcacaagccttggaagagatcatttccatttgcaggctgaagcatattggctcagactagaaaatcctgtggctacgtgagaagcaagaatgagcagtctctttctgagagatcaggagaacatggcttactagggaggcatgtgtggggagggagggggcaaagaagaagaagagtaaggagaacatgcactgggggctgctcccagcagagcacagctccagaggacaaccactgcatggtccgcaggagggaagcttggttctctcaaggctaagtgcttttcaatgagaaggcatacaggaagagcctggtcccaatgatgatggagggaggcctgataacgcatattttaaagagtctccctgcagccttcaactgcaggtatacaacataagtctaaaagctgaggagaaaaatcataagttttattgatgtatatacttgaggataacttaagttgcaaatgtttttactttaaaataaaacatctcaattccagttaaaataaaattatcagctgggcatggtggctcatgactgtaatcccagcactttgggagactgaagcaggcggatcacttgaggtaaggagttcaagaccagcctggccaacatggtgcaactccatctctactaaaaatacaaaaataagccgggcatggtggtgcacacctgtaatcccagctacttgggaggctgaggcaggagaatcgcttgaatccaggaggcaggggtttgcagtaagccaagatcacgccactgcactccagcctgggtaacagagtgagacaccatctcaaaaaaaaaaaaaaaaaaatcccatttagatcaattcgataaaactaattaggggactcaaatgtagtgtagtgcatccaataattgcaattacaacaaatatataaaaattaaaggcaacaccaggttagggaaggaggatccaagcaaggagactgtggccccagaaaggcagtgcaagtgaccctgtgatgggaatgctccactggtttgcatctagactgtggtggtgattccaggaatctacacgtgataaaactgcacagaacttacacgcacacacaaatgagtgcatgtaaaactggtgaaacctggatggactgtattgtttcaggttcccaggtgtgatattggactgtagttatgcaagatgttaccactgggggaaactaggtgaggggtatactcgatctttctgtattatttctcaactgcatccaaatctacaattttcaaaatcaaaagtttttaaaaaattaaaggcatcaaagcaaggtgtacaactggaaaatactgtcttcaaaactcatggtaacattagagaattattctctgtagctcagtgattctcaatcagagatttggaggcaggggaagggcacctaagtatcagaattactgcccacacccgctattccctgaacgcacacccacactggaactgccaccgtgatgagccacctgtttcagaggaagtgggtcaaatcttcaagtgtgctgcaactgaagaaaatggaaaaccactcttctagctacttgtctttaagaacacttctaactggtagtaaagaaaaaagcattaagagaaacatagtatttaatagtaatttataacaaacatgaaagattttcagagactgcttctcatttgatttgcccaaaatcagccaatacacccttcttggaaatgtatttggtcaacataagaaaaacattctattcatgtaagaataaaaataaggatttttttccagtaactgatggatttttcagtggtacatccagaccctaaatatcttatctataaccaatgactacaatgtatataaaggtatacagtctgtgtccttgaacagtgaaatggttcaacctacacaggagatcttagcaggcagcaccataccctagtcaacaggcgaacaatcagtaacaagcaaaaaccagaatgtgatcaatctgatactgtttttcaagtccctaccaacagggagccctaaagagaaaacctatgtttagcccactaaagtcaaacatagggaaatatgctgaagcacgaaggaggcccaatttaatatctgaataagctgcatgaatcagaacaaaaaataaaatcaccgcatgatgatgaatacaccaaagaactctagtattataattgttcacacaattgtgtgcgtctgtgtgtgtatacatcataatctaaatgtccaacaacagggaacttatgcaaaagagtggtatatccaaagccactgtcaaagcaattaaaaattgtttataataaaaaaaagtttacaatgtactgctaagaaaagagctacaaatgagtatgtggcaagattctaattttccgtttaaagtacatgtttatttttaaaaactccaaagaatataaacccaagttattatttatttttaaataagtttgttccttatactcttctctgttttctaagttttctacagcgagtacatactactcttataacttggggaaggaaaaaaaccaaactacaccaataactattttaagcaaaacttacaaaggggatggaatgatatgaaaaggaaatacatatggatattatatagacatctataattacaattattttaaagaaaggaaaactgtgcataagaaaaacaggttgtgggaaatacaccaaaataatggtgcctatgtttgaaggatgaaataattatgggtaattatttttccttccactattctacacctttaaattcttaaagaacgtgtcttacgtaaataggaaaaaaattactgtatttatcaacactgaccccaagccctccttttcactacatcctgcctcctaaaacaaaccaaaaaatacacatgcacacaaacccacaagtacttacatgggcttacatctctgtatctgtttcgatttctgttttctggaaacttggccactctatgaggatagtcatgggactcatttcgaatttccttaaaataacaaaaatatattttaatatccctcttaaattctccacagcaaaacttatcttcccagccagcgtaaaataacatgaagcacttatgatatgccaagtactatggaaagcacattgtttacatcaattaatcatttaatcctcacaatactaatggaaacgattttcttccccattatatctgtgagggatgaaaggctttcaaaggttaaaaatccaccaaagatcccatagctagtaagtggcagtcccagcattgaaccaaggtccttcagatgccaaagtctgtgctctagatctgtttacttactgctaattaggctctattcaacacctacaagcaagcatcaaacactttatgaagcagaattaatgcaatggaggtatctatggtcagccacatcatattcaaattctgactaaaactcacagcatctacctaaattttggagtttctacctgaaaatatttatttcttcatgttcacgctatttaactgttactttattttgaacccagaaatatcctcaaattttatttctatcatgtttgtcattacttctccttaaaaaaaaaattatttctagagccataaatgttcagcaacaagcctggcgcagtggctaacgcctgtaatcccaacactttgggaggccgaggcaggcggattccctgaggtcaggagtttgagacgagcctggccaacattgtgaaaacccagctctattaaaaatacaaaaatttggccaggtgtggtggctcacacctgtaataccagcgctttgggaggccgaggcggggaatcacctgaggtcaggagtttgagaccaacctggccaacaaagcgaaaccccgtctctactaaatatacaaaaaatcagctaggcgtggtgatgggtgcctgtaatcccagctactcgggaggctgaggcagaagaattgcttgaacccgggaggtggaggttacagtgagccaagatcgtgccattgcactccagtctgggcgacagagtgagactctataaaaaaaaaccccaaaaaaatacaaaaattaggctgtgcgcggtggctcatgcctgtaatcccagcactttgggaggccgaggtgggtggatcacgaggtcaggagttcaagaccagcctggccaggatggtgaaacctcgtctctactgaaactacaaaaattagccaggcgcgatggcaggcacctgtaatcccagctactcgggaggctgaggcaggagaatcgcttgaaaccgggtggctgaggttgcagtgagccgaggtcgtaccactgtactctagcctgggtgacagagtgaggcggaaaaagcaaaacaaaacaaaaattagccaagcctggtgacgagcgcctgtaatcccagctactcaggaggctgaggcatgagaatcgcttaaacccaggaggcggaggctgcagtgagctgagattgcgccactgcaacaaccagcaggcctgaggctcatcctaggcgccttcgggttctctgcatttcaacatagaagacattctgtaaggctatgtccgcactaagctctcactactgatgtatccagaatggccaggtttgatctcccaggaaacagtgttctaagaattcaagtaaatacagaaatgtaacagaaaccaaaaaaaaagcattttaataggaaaaattaaattatgcttttgctcacattattacatgtaagaaaaagcattttaaaagttaggtgccattttgtttatttgtttttatagacatagggtctcactttttgcccaggctgttctcgaacacctgggctcaagtcatctacctgcctcagcctcccaaagtgctaggattacaggtttgagccaacaccatcagccgagtatctgaagtttttatttatgaaacatgatgcacaaatttctaatatgaaacttctccatttttctggaagtgaatggactggtaagtacttttgcaagatataagacactgttattagcctgcacgtggaagagaaatttaattttatcccttccaaatggaaagttaattgacttaataccatttattggtttctgcatttatcagtaacacctgctctatcataaaccaagtttcagcacacgcaggagtctgtttctagatcctcattctacttcacagaagcatttgcttgcccttgagacagtatcaaattttagttactacagctttgtaatcaatgcatctggaaggcaagttgtcccctatttattctccccatttgcattgccgttcatgatattttaattaattttgtagttttcttcataaaggtatgctaaaggttagcataaatgtataataaaggtttattcttagatacctgataagttttgtcgctactgtaaatgggattaaaacaacaacaacaacaaaaacctattgaccattactagtgtataggaaagatatagatttgcagggaggggaggcttaaaacaacaggcagagcaggactccctccacttcttccacttctgtgatacacacacacccattttccacacttaaggccatctgtcaggtgcagatttctatttttagcccagagaaacacacttctttgtgtgcactatacaaaagagggtaaggcccccagtatagtagtagggagatttaaaatttacaaaacacaatacaacagccaagttcttggggttaagaaatacattcataacataaatacattttctcagctaataagatctcttgcattgagtccattctttcaaatctccaatattgttctactttataaaaaaaatttcagtgaacttacaagaaccaatatttcaaaaagcagctcccaaaggtgcatattagcgtttattccaatatcctctttctctttctttttttttttttgttttttgaggcagagtcttactctgttgcccaggctggagtgcagtggtgcaatctcagctcactgcaacctccacctcccgggttcaagagattctcctgtctcagcctcttgagtagctgggattacaggcatgcgccaccatgcctggctaatttttgtatttctagtagggacggagtttcactatgttggccaggctggtcttgaattcctgaccttaagtgatccgcccgcctcagcctcccaaagtgctggaattacaggcgtgagccactgcacccagccccaatatcctttctttcttactaaaggtaactgcttttgttttcagaccacaatgagcccagctgaaaactatttgtcccagcctctaaggtcctgtgacagtctggccaatgggaataagcagaaaccactgggttggggctgcaggaaaacgctgacaaagaggactggctccaggtacctttgtcctcactgctgcctgcctggaacataggttttgctgccgggggtgaggggtgggaacaggcaggagccatcctgtgacagcaaggtaaaatgcacattcctaagaaaggtaagcagaaataccagcattgagtcatgggtgacatcaagaagccacagtaacagcccttaagtctctctccagaattcatatcacatgagaaacataaactcctggttgttaaatcagctattgattaattttctttcccatgtagctaaatcaggtctgtaatatacgcagcaaaaccaaatctcaacagcaactagatctgacactgatgaggcattttcaggaatacccaagacacaaaaataaacaattttataagcacattgcataagcaataaaatatacagtatctgtctaaatggcattaggaaagcagacagctgagctattcactaggtctatcacataaggcaaagccagctctacttgtgttctggagctaaaaccttccccttctatcacagattccgaatgtttcctctgggcacagtggctcacacctgcaatcctggtgctttgggaggcccagctggaaggatcacttgagggtaggagtttgagaccagcctgggcaacacagtaagacaccagctctgccaaaaaatttttttaattagctggggatggtggtgtgcatgtgtagttccagcttcttgggaggcagagacaggaggattgcttgaactcaggagttcaagactgcagtgagctagcatcctgctactgcactctagcctgggcaacagagtaaggccctgttaaaaaaaaaaaagtttcccatcagcagtgaaacctgttaatccaaggtttctcagcctcagcactactgacattttaggctagctaattttttttgggggggggggggcaagtggggactgtcttgtgtattgcaggatgtttagcagcagcatccctggcctctacccattagatgtcagtggcacccctccctgcatctgtaacaaccaaaactctctccaggcattgccaaatgtccttccacagcaaaatccatcatgaacatatcccccaccaacacagtagagaaccaccgttctcatttaataccaaactagatctaaatggcaaggatctttgctttaaagtataatttaaccaaaaattttaaatctaattatttttaatatgatttttgctcaaaaaaagcaaggaataattgagtcactagttaatttctttcttagtggcaatgatccaaaatgtaggcaactcatagcacaaagatatctttcacagttacttataatgttgaaaggctttaaataaactaaatgtctaatgacaaagaaaagactggttgaataaatcgtggtacatccaagtgaatatcatgcagctcttttaaaaacaggccctcataccaaattggcagtagcataaactcacaatctcttggaaagataatatatgacataaacaaaggaaaaacaaatcagtaaatggaactgagctattattaatacacgctatttggtaaaaaaaaaaaaaaaaaattccacttagctccttagctgtatttgaaacttaaacacacatgtgcattgcctacattaagaccacacaccacctttttccaaagtagtctaatttttggaacattatgaaatggtccattctgatcaatggccttatagcttatctccatgcccaaagattttaaattgtaaacatacctactttccttttttttttttgagacagagtcttgctctgttgccaggctagggtgcagtggtgcaatctcggctcactgcaacctcagcctccagggttaaatcgattctcctgcctcagcctcccgagtagctgggaccacaaatgcccgccaccacgcccggctaatttttttttgtatttttagtagagacggggtttcaccgtgttagccaggatggtctcgatctcctgacctcgtgatctgcccgcctcagcctcccaaagtgctgggattacaggcataagccaccgcgcctggcctgaacatacctactttcaatgtgtttactttctcctattatttcacctcctaatattttcacataataacatttaatccctcttgaaatttgctttgagatatatatgcatggcttaaaataaggaactaaattgattctactatagaaataattttgctgggttcaaataatgctgggttgaaatgtaagagtaagattttttatattcatctagctactcttcatttcataagcagtaactgtgcctaaatggtactgtttaaatacagggactctcaaaagtctcaggacttctgcttaagaaattccaaaagtatacttcacataaagtcatcattatactttgtttttcattgcaacaagcctttcaagagaatcacagaattcagaaggatatctttaagcagacattcatagaatcctcaaactaacttggtgttataggatggtcttgaaagaaactgaggccaggcgctgtgagtcatgcctgcaatcccaatactttgggaggctgaggtgggagaatcacttgagaccagtctgggcaacacagacagacccccatctctattaaaaaattttaaaattagcaaggcatggtggtacacatctgtggtcccagctacttgggaggcagaagtgggaggatcacttgagctcaggaggtcaaagctgcagtaagccgtgatcacgccactgcatgccagcctggacaacagagcaagactctgtctttattaaaaaaaaaaaaaaaagagagaggcggggcacagtggctcatgcctgtaatcctagcactttggaaggctgaggtgggtggatcgcctgaggtcaagagtttgagaccagcctggtcaacacggtgaaaccctgctgaggtgggcagattgcctgagctcaggagtttgagaccagcctgggcaacatggtgaaaccctgtctctactaaaataaaaagagtgagctgggcaaaaagagtgagctgggcgtcatggcatgtgtctgtagtcccagctactcggaaggctgaggaacgagaattgcttgaacccaggaggcggaggttgcagtgagccgagataacgccactgcactccagccccaccccactcccaaaaaaaaaaccaaaaaacaaaaaactaaaggttaaaatgatgtagccactttagaaaaacaaatgctgaacaaagagttaacatatgaactagctattctactccaaggcacatacccaagagaaacgaatacatacattcacacaaaaacttggacacatatgttcatggtagcacttttaataatagctaaaacaatcatttgtccatcaactggtgaatggataaacaaaatggtatatatctatataatggaatcttactaacttagaagaagaaacaaagtaatgatacatacaacacagatgaaactttaaaacattatgctaagttaaagaaaccagccgggcgcggtggctcacgcctgtaaccctagcactttgggaggccgaggcaggtggatcacgaggtcaggagatcgagaccatcctggctaacacagtgaaaccccatctctactaaaaatacaaaaaattagccgggtgtggtggcgggcgcctgtagtcccagctactggggaggctgaggcaggagaatggcgtgaacccaggaggcggggcttgcagtgagccaagattgcaccactgcactccagcctaggcgacagagccagactcctctcaaaaacaaaacaaaacaaaacaaaacaaaacaaaacaaaacaaaaaaacagatacaaaagactacacatggtatgagaccaggacagggaaatctggagacagaaagtagattagtggttgtcaggggttgggatgtgggtgagaatggagaataactgtatgtacccagtctctccttggggtgttgaaaatattctgaaattaagatttagttccacagctgtgaatatactaaaaaccactaaactgtaccttttaggtgaattttatggtatgtgaaatatatctcggccgggcgtggtggctcatgcctgtaatcccagcactttgggaggccgaggcaaatcacgaggtcaggagatcgagaccatcctggctaacatggtgaaactccatctctactaaaaaatacaaaaaattagctggccatggtggtgggcacctgtagtcccagctactcgggacactgaggcaggagaattgcttgaacccagaaggcggtggttgcagtgagccgagatcgcgccactcactgcattccagcctgggtgacagagcaagattgtctccaaaaaacaaaaaacaaacaaacaaaaaaaaaaaacaaaaacactctgggccaaggcaggaggatcatttgaggccaggagttcaagaccagcctgggcaacatggtgaaaccacgtatctacaaaaaataaaaataaaaataaacacataataaataaaaataaagccaagcgtagtgatgcgtgcctgcagtcccagctacttgggaggcaaagctgggaggatcacttgagcccaggaggtcaaggctgcagtgagcagtgactgtaccactgcactccagcctgggtgacaaagtgagaacctgtctcaataaataaataaataaataaataaatgaaataaaaatggaactcctgtattaagggcatattttgccaatatttctcaagaaagactgaaagtgaggttttgcctcacactcaacagtatcagtacttttttttttgtcctcagatgttgtcaagatttttctgtattgcttactctttcagatgtacctcaaatttaaactttcttttggctgacttcaaaaaaaatacattatagatatgtgccaagtcttcatcggaactgggttagcttctccatttgagtcttccttgtcgcttaatagagtttcgcttcagtctcctctgttccctttcaggaatttctatcacagacttggggaagtgctctctcctaacgctcatttcgcacacctctttcctgagttctgagagatttttctcaagccacctcagtgttctgcattatctactctgctacttggtactgaacattctattttaacaattgtgtgttataactttaaaaactctttactgttctcagtttcttttcttttctccacctgctcttgtatttggacacctgaattacagctgcctctacctcatactattttgcatgccctcaatgatcttggggtgaatttttcgtttgtctaacaacatatgtttggtcatctttacagaaagtgaatacacacatcagttcttaacccacacctgtgtggccgcttacactgttcactatcaactccttaagtctcaaatatgtgggaaagacccttctctagtgtgaagtaatcacaaaggcttgttcttaccactgcgctttggtcacttcaatgataaatcagaaaacaacaacaaaagcttccagtgcatgggattacaagaccttaatagtcctgggaaattacacttatttgtcatagttgttgttttttgttttttgtttttttttgagattgagtctcactctgtctggactgactggagagactggagtgaagtggcgccatctcagctcactgtaacctccgcctcccgggttcaagtgaattctcctgcctcagcctcccaagtgactgggataacaggtgcacatcaccatgcctggctaatttttgtattttttagtagagacagggtctcaccatgttagccaggcttgtcttgaactactgacctcaggtgatccgcccgccttggcctcccaaagtgctgggattacaggcgtgagccatcaccttcatttgtcatagttttctactgcctttcttgctgtcaatttttacctctatttacacaattatgcctaacaactctttctttttaaaaacttcaaacttcaggccgggcgtggtggctcacgtttgtaattccagcactttgggaggctgaggcgggcggatcacgagttcagggagattgagaccaggtgatctgcccgcttcagcctccccaagtgctgggattacaggcgtgagctaccacacccagctcctgatttgttttaacaagtgaagctataaaacaaaggctcatattctgaattttaaagttttaaggctgggtgcggtggctcacgcctgtaatcccaacactttgcggggcccaggcaggcggatcacttgacattaggagtttgagaccagccttgccaacatggcaaaaccctgtctctactaaaagtacaaaaactagctgggcatagtggcacgtacctgtaatcccagctactcgggaggctgaggcaggagaatcgcttgaactccggaggcagaggttacggtgagccgagaacacaccactacaccccagcctgggaaaaagagagacgccgtctcaaaaaaataaacaagtaaaattttaattttattttacttatatttttgagacaaagtcttgccttgtcactcaggctggaatgcagtggtgtgatcacagctcactgcagctttgacttcaggggctcaagtgatccccccacctcagcctcccaagtaggtgggactgcaggcacaccaccatgcctggctaattttttatttttatttgctatgttgcttagactggtctcaaactcctggtctcaagcaatctgcctgcctcggccttccaaagcgctggtatcacaggcgtgagccatggcgcctggttttgaagtttttattttaaaaatctatattactgcaacttaatttccatcattatcggggtgaaatagttataatattttattaaataatgtcaaataatatttttagtatttcgtacatagctttgttctatgtatggcatacagaaaacattacatcgttagaccaaattctccctcgaactgctacgatgtagtagcaaataagaacttaggaaattgaaaaagaataatcttctgttaaattttaattttataaggtaggaccttaagataatcccaaattgataatgagtttctccttatgggctaacatacctaagtttctttctttatactttaggtctctaagtgaatcctaaattatatgatgaaaagtgttccctttgttagtcagatgtttgtgcatatactctctacaaagatgctcagaaaaggacacagtgaagtatgaagaatcttgcatactttgaaacaccattactttaggatggtaaaataaccacttacttatagcccttaatatgcctgccactggctggggagagaagatccctggtggagtaagttcttttcttcactacatttttttttctttgagaagctctctttgaggaagagagtttagagactaaaacagctcactgtcactgaaccctactgtgtgtcaggcatgtgctatgtgcttttatgtgtgttatctaagaggtggttacaaatgagaaaacagactcaacttccaagatttatactgcagttaggtagcagatacagataggaatccagtacttaactttagcatatatatatatatgtatatatatacatatacatatatatgtgtatatatacatatatatgtgtatatatatgtatatatatacatatatatgtgtatatatatgtgtatatatacatatatatacgtatatatgtatatatacacgtatatatatgtatatatatacgtatatatatatgtgtatatatatatatatatatatagagagagagagagagagagagagagagagagagagaaaagcgtgttgttttttttttttttttgagacagagtttcactctgttgcccaggctggagtgcagtggcgcgatcttggcttactgcaagctccacctcccaggtttacaccattctcctgcctcagcctcccgagcagctgggactacaggcgcccgcaaccacgcccggctactttttttgtgtttttagtagagacggggtttcaccgtgttagccaggatggtctcgatctcctgacctcatgatccgcccacctcggcctcccaaagtgctgagattacaggagtgagccaccgcgcccggcagcacatacatatttttttacttatatttacatatatttatatacatatgctccctatgtatacatggattacatggacttggcaaaaattaaaccgtacaaaagggtatatagtgaaaaagttaagtcacattctcctctccctcaatcctttcccttaggtgataactgtaaccagtgccttgtatattttccgagacattctatccatatataagccagactgcctgtctgtcttcctccatccaagtatccatcccaccctcacaaaacagatattagcatactgttttgcactttgatttttcacttagtatatattaaaagtacttccatatagataatgagttctttttaacaatttaatagtattcatcacttagccagtcatctataatgggacacataggttatttctaggttttagctgttataaataatgctgctatgaataacctttcaaagaagctatatcaatgtatactgtcaccaataatataagaaagtgcctgagcttcacctacacaattatattaatgaactttttcatctttgtctgataggtgaaaaatggtattattatagtcataatttgaaattgttattattgtgaaggtgaacagctttacctgtttttaaaagccatctgtatttccgctctctttttgatatgtagttctttacatattaagaaagtttagtttttgttatatattgaaaatatttaaaattttttatcttttgacctttatggtatttatgtcaaaaatttaaatttttatgaaatcaaacttaaaccttttttctctaggtttctgtgacatggcattaaaaaatcctttttcactctgttgattacaaaaaattttctccattgttttcttatataattttatggtttcatttcttttatgtttagattattgcccaaccgggactttactgtagtataaagaatgaggcagggcaggcatgttggctcacatgtataatcccagctctctgagaggtgggctgatcacttgaagtcaggagttcaagaccagcctggccaacatggggaaaccctgtctctactaaaaatacaacaattagctgggcgtggtggtgcacgcctgtaatcccagctactgaggaggctgaggcaggagaatcgcttgaactcagcatgcagaggttgcagtaagccgagatcgtgccgtagcattccagcctggggccacagagcaagactctgtctcaaaaaaaaaacaaaaaaacaaaaaaacaaaaacaaataaaaaacccacaaaaaacatagaacagaagcagttcccactgttacgaagttactccaactttctagggctaccctgattgatgtaccaggtcctttactgggactagaggggtacaaactctaggaatcctgtagccttacctcaaaccacaggaagaattcctagaagtactatgaagtaaactgtaatgagaaattgatagctttcagactataaaaccgttcaaatatagtgaaagaagaaataaaataattcagtatcagattttccttaggggaatgaaagcagtttgaaaaaaggttataaatgatcagtgacacgaaccaaatgaaactgacagagcaaacggcatattaaatcagacatactggatttgaaaagttattcattgcattcccttcctccattcctctcgtttgaaaagtatccaaccttgagccagtttctttgttttgagacaaacagtgctgggattacaggtgtaagccaccagcccggcccctgaaatcagtttcttgaccacaatttcttatcctagggatcaccaggtgggcctatgaacctactaaaaccacatgctaagtttgcgggggattgtatttgtgcggacatttcctctcataaacatgtttcatcttaaaggtgtctaaaggtatctatgatctttaaaagcaaggatttcactgttaagtcaaaacaacttcttgaaccattagtagtactgtaccgtacatagaacattaaatcggcacaacatttaaatacatttaaaatggcattacattcattcttaaaagctatttcagataatggcactgcagggcaatgctattccaattaagaatgtaacaggctggacgcggtggctcacgcctgtaatcccagcaatttgggaggccaaggtgggtggatcacctgaggtcaggagttcaagactggcccagccaacacagcgaaaccccatctctactaaaaatacaaaaattagctgggtgtggtggcgcatgcctgtagtccctgctacttgggaggctgaggcaggagaatcacttgaaccagggaggtggaggttgcagtgagccaagatcgtgccactgcactccagcctggttgacagagtaagactccgtctcaagaaaaaaaaaaaaaagcctctccctctccctctgcctcctctccctctccccacggtctccgtctccccacggtctccctctccctctctttccacagtctccctctgatgccgagccgaagctggactgtactgctgccatctcggctcactgcaacctccctgcctgattctcctgcctcagcctgcagagtgcctgcgagtgcaggtgcgcgccgccatgcctgactggttttcgtatttttttgggggagacggggtttcgctgtgttggccgggctggcctccagctcctaaccgcgagtgatccgccagcctcggcctccggaggtgccgggattgcagacggtgtctggttcactcagtgctcaatggtgcccaggctggagtgcagtggcgtgatctcggctcgctacaacctccacctcccagccgcctgccttggcctcccaaagtgcccagagtgcagcctctgcctggccgccaccccgtctaggaagtgaggagcgtctctgcctggccacccatcgtctgggatgttaggagcccctctgcctggctgcccagtctggaaagtgatgagcatctctgcccggccgccatcccatctaggaagtgaggagcgtctctgcccggctgcccatcgtctgagatgtggggagtgcctttgccccgccgccccgtctgggatgtgaggagcgcctctgcccggtcgcgaccccgtctgggaggtgaggagcgtctctgcccagccgccccatctgagaagggaggagaccctccacctggcaaccgccccgtctgagaagtgaggagaccctccgcccggcagccgccccgtctgagaagtgaggagcccctccgcccggcagccaccctgtctgggaagtgaggagcgtctccacctggcagccgccccgtccaggagggaggtgggggtcagcccccgccaggcgagccgccccatctgggagggaggttggggggtcagccccccgcccggccagccgccccgtccgggagggaggtggggggttcagccccccgcccggccagccgccccgtccgggagggaggtgggggggtcagccccccgcttggccagccgccccgtctgggaggtgaggggcgcctctgcccggccgcccctactgggaagtgaggagccccttccgggagggaggtggggggatcagcccccgcccggcctgccgcctcgtccgggaggtgaggggcgcctctgcccggccgcccctactgggaagtgaggagcccctctgcccggccagccgccccgtccgggaggaaggtgggggggggtcagctccccgcccggccagccgccccgtccgggagggaggtggggggttcagccccccgcccggccagccgccccgtccgggagggaggtgggggggtcagccccccgcccggccagccgccccgtccgggagggaggtgggggggtcaacccctcgcccggccagccgccccacccgggaggtgaggggcgcctctgcccggccgcccctactgggaagtgaggagcccctctgcccggccaccaccctgtctgggaggtgtgcccaacagctcattgagaacaggccatgatgacaatggtggttttgtggaatagaaagcagggaaaggtggggaaaagattgagaaatcggatggttgccgtgtctgtgtggaaagaagtagacatgggagacttttcattttgttctgtactaagaaaaattcttctgccttgggatcctgttgatctgtgaccttaccccccaaccctgtgctctctgaaacatgtgctgtgtccactcagggttaaatggattaagggcagtgcaagatgtgctttgttaaacagatgcttgaaggcagcatgctcgttaacagtcatcaccactccctaatctcaagtacccagggacacaaacactgcggaaggcctcagggtcctctgcctaggaaaaccagagacctttgttcacttgtttatctgctgaccttcccttcactattgtcctatgaccctgccaaatccctctctgtgagaaacacccaagaatgatcaataaaaataaaaattaaaaaaaaaaaaagcatagaacagaaaagtttagttttcttctactcaggaaagtgagagcttatattctttaaagttagcctgtggaaatgtatctcttcctcagttatcagctgctatgtcttaaattttacatgctaaactgattgaggatttagtatatggctaatcactcttatccaaagtaagggtggtattattaaaagttcagtttattagttggtttaaatatcctctgactctcaacagctttccattaagaaaaaactaccttaatggggcattaagttaaggaatagagagtagagaatctagatgaggatttccaagggaaacaaatcatacgtaacgtttattcaagaaagtgaagagcacactatgttaattttaatttcgcgtacccagaccttatctgtccatctctctggtttatctggactatttggagaccaaagggaagaaggggagtagagagtggacaggtaagaggacaaagacaaggtagctaaaagaacagcaggggactgagagagctgtaacagttctccaactgggaatcagaaattctctgcagagtaactatctggaaaaagtaaaaagggcttttaagattctggttggccaagcactgtggctccccagcattatggaagggtgaagccggaagatcgctttagcccgggagttcgagaccagtctggacaacatggtgagaacctgtctctacaaaacataaaaaattagccaagcatggtggcgtgcatctgtgcagtgagccgtgatctcatcactgcactccagtctgggtgacagagtgagaccctgtctcaaaaaacaaaacaaaacaaaattctggttaagggctgggcatggtggctcatgcctgtaatctcgccacttcgggaagccaaggtgagcagaccacttgaggccgggagttcaagaccagaccagcctggccaacaagaacaacaacaaaaagaagaagaagaagaagaaatttgtcaggcgtggtggtgtgtgcctgtagtcccagcttctcgggaggctgaggcaaaggaccacttgagccaggagttttgagtctgcagtgacctacgatcgtgccactgcactccagcctgggtgacggaatgagaccccttctcaagaaaaaaagaagattctggttaaaatcaagaaatcaaaaaagaggcaactagaaaagctaggagacaaacgcaactatctggatttccgtaattatagatatcagtaatctataaacacatgtcaaaggcaaaacaatatgatttctaggtatacattccccattggggcacccatcccaaggctgctttcccttcaagcagtggtctttaccttttgagggatcacagacaaatccactaagaaactgacaaaagctacagaatcacctagaaacgaaatacctgggaacacacgtacataaaatttagcagtttcaggagatttgcaaatacctttcaagtctgatccctggatcccagacactgttttaaaggcctcaagtcccaaaatgaccctacctattataacacatccactccctcctagccatcaaaattaagacgattccctctgtgccactgatctcaaatagatcataagaagaaagcactacaggtagtcacatgggtaaattagggcagtgctgaaacgagaatcagaaggactggatttgagtcccagttatgacactagcagatattgtaacatcagataagtcacaacactgtattggcccagtgtttcctcagccataaatgaggggtttggaataaactaaggtgctgacattttaaaagggaacagttttcctgtgtttactgaatatttactgagcatctaacatgtttcaggtcccgtaggtaggtggtgggaaaacaaagaaaaaaaaagaccaccctcaaggagctacacagaacagacaagtagacagttacaaaacaatgtggttcatattctaataaaagaatatagagaactaagaaatgagagaagggggagcatttaactttgcccaaggagactacggtctagtcttgaagatgtttcccaaatagatatggtaggcatggagtatatccaacacatgaagactccaaggtgtgagagagtagccaatcttcaagggaattcagagtttgtgcaaccatgtaaaagcactgagattagacagcaggcaggagaatgtgtaactagtaggcaagggaagtgttttagaataagacagctttgattcacctgcctaactggctgccccgctgtaagtatgagaagaacagtgtgcacttgatatctgacttctaaaaattagctgactcacaaatggtaaaaattgttctctagcaatatttgaactacaaatttctaataaagaaaaatggcggccaggcgcagtggctcatgcctataatcccagcactttgggaggccgaggcaggtggatcacaaagtcaggagatcaagaccatcctggctaacacggtcaaaccccgtctctactaaaaatacaaaaaattagcctggcgtggtggcgggcgcctgtagtgttggcgggcgcctgtagtcccagctactcagaaggctgaggcaggagaatggcgtgaacctgggaggcagagcttgcagcgagccgagatgacgccactgcactccagcctgggcaacagagcaagactgtctcaaaaaaagaaaaagaaaaaagaaaaatggccaggcacagtggctcatgcttgtaatcctaagcctttggaaggctgaggtggacagattgcttgaactcaggagttgaagaccagcctgggcaaaatagttaaaccctgtctctacaaaaaatacaaaaaaattagccaggcccagctacgtgggggactgaggcaggaggatgtctaaagcccaagaggtcgagactgcagtgagctgagatcacgccactgcactccagactgggtgacaaagtgagacccagtctcaaaaagaaaagaaagaaaaagaaaaaaaaagaaagaaaaaggaaaaaaagaaagaaaaagaaaaatgtggctgggcgtggtggctcacacctgtaatcccagcagcactttgggaggccgaggcaggtggatcacctgaggtcaggagttcaagaccagcctgacaaacatggtgaaaccccgtttctactaaaaatacaaaaattagctgggcgtgctggtgggcacctgtaatcccagctactcgggaggctgaggcagtagaactgcttgaacctggggggagcagaggttgcagtgagctgagatcacactactgcactccagcctgggggacagagcaagacttggtttcaaaaaaagaaaaatgaagtcagtcaggagttccattgtttataaaccctaattaatcaaccaatttccaagaggctgaggtgagaggctcacctgagcccaggagtttaaggttgcagtgagctatgattgcaccactgcacttgtactccagactgggcaacagagtgagaactctttaaaaaagaaaggaatttaaaaataaataagccaaattccttctgagccatcacttcttagaaacaacccataacatagcttttgcgattccccagttttagtcttttcctcagtaggcacacagactccattccttctctctgcctttctcaaagctcagcctgatgaagacagcaatcagcagtgacaaaaggaaaagccaaaaagggatcatgaacattactcaaaaagtcagaattaacctcacacaatcagaccaaattaaacttttccaactgcaccctttgttttgctgttcttgttttagagacaggatctcactctgtcacctagtctgtagtgcagtggcacaattatggctcactgcagccctaacctcctgacctcaagtgatcctcccacctcagcctcccaaagcgctgggattacagggatgagccaccgcctggccagcactctttcacgatcaattcttccacctgtgtgctcttggtcccattgactcttgctttctaagatttctggctccaacaatcatcccttctatttcaacctccacctctctctttaggttcatccctgcaatcacataaatatatcaagttgccctttcctcgtaaaaagtcattcattcagcacatattttcaagtgcttactaagcacctgatactgtgcaaagcactggcagtgccttcatgaaactctgaagaagtaataaaaaatataaactcagattaacagagtctgttctgctccaacccaataattcatttctaagaaacctcctattatcaaactcatgaaataaaagacacttttcaaaaggagcaaaaaggaataagggaccagagttccagactcaaaatactaaattcatttttcccgctagaatttcaacaaggtatcaagttctcctaccactaagcaagtccagcttttagttgtactcagtttttgctcaagagcaaagcctttcttttcccagctccatgagcattaccaaaaaaagcacaactcttcaaaaacattatcagaaacatcacccactgctgtgctaaacaaagcagaaagccaccttaaacacttttttcctactcaagctgtgttactttcaagatagtggtttgcttaatgcaaattgtgttcccgaaatcatttgctgctgtatgacatccaattcccgctatgaaaggggaagtcttgggatgctaaagaagtacgcaacaggggctcatacccagcatgggcaggtcaagaaggcctgccaaggaagtgagacttcagggatgagtaggaggcagtttaagcaagaaaggaaagagaaggggggaaagttgtgccaaggcaaagagaacaacatttacaaacgccctaaggggagaatggacacacacacttccaagaatacaacacagtggaaaagagggaggaaagtgataggggaaatcaagcaagagacacaggccatgaggtcttgtgagccggaggaggggctgaatttacactgtgagcaacggaaagccgttcaagggtttaagtgagaagtcacacaatcttgcttcattttagctacctctccccacttcttcaagttgggcttctaaaaagagcagtgtacacttggtagtttgcatttcctcctaccttctctcctgaactccaggtatctgtcttgtgtagtccgctgacacaactccctttaaggtatctgttaatctagctgctcaatgtcatggccctctcaggctggcccttacctgtcaggtggccctgctcaccctcaactccctccactgctttcctccccacttctgtggttgttcctcaccagtcttttttgcaagttcctctttctccacccatccttttaaatgttgtctgtcaagattctgtccttggcctttgatatttccaaacgctctgtatcttccctagatgatctcatcaatgtctaagacctcaaatatcacccatgtgttcatgatttccaaaatcacatttactcagaccctctctcccgaactccaaatttatacattcaactagcttcatttcagtgtctcgcaggtacctcaaacagaattaaagtttcaaaaccaaacttgtacataacgtatacccctttaccatttcatttcaaatctgtatctcccctccatccctcctgccactgcctaacagaagctcatcatgtctcttcaggtttactccaaccgactactgccctgtgctgcgtgcctacactttcctcatccagtctgctagcagtcagaacgatcttgctaacaagtaaatatgatcagcccagagcagtggctcatgcctgtaatcccagcactttgagaggccgaggcaggcggatcacctgaggtcaggagttcgagaccagcctggccaacatgtcgaaaccctgtctctactaaaagtacaaaaaaatcaaccgggcatggtggtgtgtgcctgtaatttcaactacgcaggaggctgaggtaagtgaatcacttgaacccaggaggcagaggttgcagtgagctgacgtcgcaccactgcactccagcctgggcgacagagcgggactctgtcaaaaaaaaaagaagcaaatatgatcatggtatttccagacttacaattccacaatgagttcctattaaacagctcaaattccttagtctgatctaggctctgccttactctccagcatctcaacttcacaccagtctccaggctaaactgtgggtggttctctcagcattccctcagtgcctttgtgcactccctccttgctggaacagtaattctcttcacctcccttgtcctcttcccctggccaatgtctttcaagacttaggtgaggtcctccctccctcgagaagcttcaccagaactcccatgtgtacccctttttgggaaatacaggactcctaggtaactcaactccacaagaccctgtgcttcaagctagctttacatgtatcactttaacgttttcatcagcttacctatttacagggctgcatccttaaaaactgggactcctgtcttttaacaagaatcctcagtgtctaacactagcacataacaagcatgttatgaacgaatgaatgaaaatatggaactacaatgaggccccaaaagaataagccctagagtgagcacctcgagggtaggaaacttgccaggagcattctctgctgaatccccaaggccaggagcaaaagctgcaactccactgggggtccgggcatatttgtggaatggctgaatggatgttctaaggccacaggagaacacatagctcaaacttcctgacttgctttccattactaactttcttggtttgtgacctacttttactgtaacaccagtgtgcatgccatggtttctactgaccaaactaatggtcttgttttcaactaggaaaaaataatatgagcattgaccaaccaaggaaactacaggattcctcggtaagaatctatagaaggatttccttatctttttgaaaatgcatgtgaaatctccagtggatgcgagttaagttcatttttctggaaagaggaatcacaattctcattgaattttcaaggatattaatgataccaaagaaaattaaatttcttaaaccaaaatgttaagctgaattaagttatattcacttttctcttttcaaatctatttcgatatataacctatcccttagagagacagcagcctctgctaaaacaaatgtaactggagaagatgcagctggcaggctctctcacatgaagattcctaccagaatttgcgtttcagattgtctataattggaagagtccttaccagcattctttaaaacttagatccctattctaacatactctgtatcatgggaatcagaatatttatacttcccactaatgtgttcaagaagaaaacgttactttctgaacacatttttcactgccatctaattaaatggaaaggggaaaaacccaggatcatccatttacaggaaagcccgtcttttactttacacagagagaaccaaacatcagaagcagcattaacttaaccgtcaccaaattcaatcttgggaataatacgacaaggattaaacgaaggggaaagcagttacatcattttaaaagagataaagttttgtttgaattaaaaggtagtctagttgacataaaaaaagcgaatcacaggtgtttatactacatattgcatctatgtgagctgaacaggcacgattagggcgataggcatcggaacaccgtgcccccggggaggggatgagggcactttctcagggcaaggaaaggctattttgatttgagggggcttgcaagaggggattcatttgtgacacccgtctgggagcacacatgaaagctgcgtttcactgtagggaaagtatacctcagtaaggaaaactataaagagaatgacacgctatcactggacgaacacaagcaaagcctctttcgttccgggaaggttctatgggggccgaacccacgctgggcgctgctgggccacgggggaaaatgaagacggagggtcccgagagcgctgccctcgccagaggccacgagccacccccaaccaccgcggctccgccaggagagcgagcttcgcctcgcagagggctgcggcggccggcccggcgcccagagcggcctgctcccacaggtcctgcgcgggcgccagctggacccggacgccgcggcccggctcgcccgcccccgccctcaccgctcccggggacgccagctgcccacccggccacaaaacacccggccagagaaagagctgtccgcgagcaagaaccaagcacagcggcgtgggagctacggcgaagctgcggcccgggggcgcgcgcccgagcgcccccacggctttcccaaggacccccagacccgggccgcgcaacgctggtggcgcatccacgcgctccccaagaagccgctgtggcaccgccctccagaactaactgcgcttgcgctaaccatgagctgctcagctcaagtatgctttttttttttttttttttaaaccaaaaggagcaagagagcggtcagcgcaggcgcgcccctgacgcggaccgcgccgccacttccgccccgagcgagaggctagaggcgagaggcgggggaggcgggagggaccctgcggacagggcacgagtccgggtctcggaggaggtcggcgactgccgcgtgggtccgcgactcaccaagtacagcggctgccagcgacgctgagtatccaactcttcgaactcccgctcgatggtggtgggcatggctgcgggagcgagctggcgcgagcagagcctgcgccggcggagaggctcaggccccgcacgatccggggagagcgctggcgctgcggcgcatgcgcgctgcgcgccgcgccccgcccccacgccaagccctgtcggccgtggggaaagtacctggagcgtcggacgtcagcgcgcagactcggcgcccgagc

SEQ ID NO: 388 - DNA, 98858 bp, Homo sapiens; identical to SEQ ID NO: 387
  source 1..98858: mol_type = genomic DNA

SEQ ID NO: 389 - DNA, 98858 bp, Homo sapiens; identical to SEQ ID NO: 387
  source 1..98858: mol_type = genomic DNA

SEQ ID NO: 390 - DNA, 92034 bp, Homo sapiens
  source 1..92034: mol_type = genomic DNA
gagacgaagtcttgctctgttgccaggctggagtgcagtggtgcaatctcggctcactgcaacctctgcctcccgggttcaagtgattctcctgccttagcctcccaaggagctgggactacaggcatgcaccaccacgcccagataatttttgtatttttagtaaagaagggatttcaccatgttggccaggacagtctccatctcttgacctcgtgatccgcccgccttggccttccgaagtgctgggattacaagcgtgagccaccacacccggcccaaactgttttttttgtttgtttcttttgagatggagtctcgctctgtcgccctggctggagtgcagtgacgtgatctcagctcactgcaacctccatctcctgggttcaagcaattctcctacctcagcctcctgagtagctgagattacaggtgccctccaccatgcccagctaatttttgcatttttagtagagatggtgtttcaccacgttggccaggctggtcttgaactcctgacctcaggtgatctgcccacttcagcctcccaaagtgctgggattacaggcatgagccaccgcgcccgaccaaactgtttttaaatgataactgccccctttaaaatacttaagccttatgcagaaatcttatgtggcatataaagagacaaggcagagatgctgtggttgaaagtaacctcttgacccacctggacatccaatgagcatagtttgaaaaccactgaaataaggtatgctatccataataatgtatgctatccatgcctcctagcaattaaatttgtaacaacaatttcaagtttaagtaagacaaattaaacactgaatggaatgttgaaatctgaggaaagctagcattcaaatgagcagttaaattcattaaacagtttgctttaaaaaatattcattaagttaaaatgacaatgtaaggtttgcatataatcatactatttattgaagtagaaagaaactgaaaagtgtttacttcaaaacttcagtctagtaaactgaaattatgaatcataaaatgctgcttcttacttttgcttcctaaatcataatctaccccaactacattgaaattttcatgaaaaataaacatatcaataatgggatttacagaaaccaatttctttacaaagtcttgaccaactgtttacctgactatcccagtaaggagaattttccttcaaagatatttttaggaaaaacttttgtttctttgtttgcttttctttttaaaatggggaaaactgtaaaacataaaagaaatgcaatatatagtagaaattgcttattccaacttctaactgctcatatcaaacttctctttagaaaaatggaaaatgtatccagtacaattcaatcgacatacaatttatttttttagtaacagatttttcaaattgagctcttaaaaagtacagttaactacaaaagattaaatagatacttataaaatatatttaccctgaaatgcttaagaataaaagtgttgatgcccatgtcaatagtacattatacattacacacattatttaaatgtcattttctttccaataacgtagataaaaccacaatatttattgcttatatcaagtgcaggttaaaatccagatagcctccaaaaacaaatcctgtgataaaggatatctcaatgttggtcaggtgaaatactgtgtttgacatgtatgaatacagttgcaaaatttaccagtttttaacaaacatgaatgtctttattttagacagccatttacagtttggggttcagaggaacctgcagtcaagagtcctgagatgttgggcttgtgactgtaaatatcacttatctggttgatgtctattctactgcaccgtttttgggatatgaggcgtttgctgcagacaaacccctatgattaatgtagcactgtcagttactagtgcagaagcttgctgggcaaaattaattgtttatagggcattttgctgaaaaaacagtgtccagccaacaaaagcgccaaccaaaatgactgacataaaccccatcttagtgagaataggttgccaatataaccacctttttctttttcgttcattctcatttagcctctgtttcatctgctgcaccttctgagctgtggtggcctttctgtcctctcgaatacgtttccgtagagcactatgaggaaataaaaacaagtgaaaggaagtgcacacagagcaggacttgagtactctaacacagaggacctaggcgcaaataaaaccatccacatagttttcaccctatttgaacactggaataatgaggggaaaagcctcaatattcttttgagacagcgtcttgctctgtcacccagcctggagtgcagtggtacaatcttggttcactgcaacctctgcctcccacgctcaagtgattctcgtgcctcagcctcccaagtaactgagactgcaggcgtgcaccactatgcccagctaattttttgtatttttagtagagacagggttttgccatgttggccaggctggtcttgaactcctgacctcaagcaattcacccgccttggcctcccaaagtcctgagattacaggtgtgagccacggcgcccggccaagaaaagcctcaatattctttaatgattcagagatgtaccttgacaaccattcctggtacagttttatattgataactgcttttagtgggacctgaaaataagcaaggtactttcttgacacgtgaattgatgactgttagttttctttccttccttgttaactagtcagcaggagcaggagtgggaagacaagggggtaccacttgcatctgatcccatttcctggtcacgtttgatggttaaggctcttataaaagctagctatttaatatttccatgaatattctgttgtgggagcacttattcttttatttgaccatacacatttctacctcccattttcatagtcaatacagaaatttttttggggtggtgggggaggcggggtggatggagtcttgttctgttgcccaggcgggagtgcagtggcacgatcttggctcactgcaacccccgccttccgggttcaagcaattcttctgcctcagcctcccaagtagctgggattacagacgtgcaccaccacgcctggctaatttttttgtatttttagtgagatgatgtttcaccatgttagccaggctggtcttgaactcctgatctcaagtgatccgcccacctcagcctcccaaagtgctgggattacaggcatgagccactgtgtccggtctcagaaattttgtttcagtggaaggtctctgactctcaagatacttagttctggttctatataaataataatgccatccagctactcaggaggacggcttaagcccaggaattcaagtccagcttgtgcaatatagcaagtcttgcctctctataaaagcacacccacaaaaacaaaaaaacggccaatggcaacatataggttactatttcttccattccctcttttcacttttctgtattacagcaaaggcctaaccagcttccctgccctcaaattaaatattattgccatggtaatttttctagagcatacccctggacacgtagcttgatttaaaatctttttttttttttttcgttaccgggcctagtgcacgatggtgcttaaaaatctcaaatgcctcttcaatgtctcctacattgagactacctttttcctggccaagacgtttaacctgaatttaactatgataaataatgattaaagaaatgcattgtatggggcattctaaaagatatctggcctagaagcttcaaaaatacaaatgtcaagcaaggaagaaaaaggcagggaacagttccagattaaaggagaccaaagaatcacatcaactaaatatagtatcaatctttgattaatcttgaaatattttttaaacagctacagaagttgggatcaggaaaatgttctaaaattagatcgtggtgccagctacacaatttggtaaatatattaaaagtcactgaattgtatactttaaatgagtaaactttatgctatataaattatatttccataaaactttattaaaaaagctatatggtgaatctttcagacaagagaaatctgaattgaactatgtattagaatattttaatcaatgttacacttctttggtgtactggaaccttctctccccaagagattgttagtgggaatgtaaaatggttcagctgccacagaaaacagtttgacagctcctcaaaaagttaaacatagagttaccatatgacctagcaattccactcctagatatgtacccaagagaactgagaacacatgtccatgcaaacgcttgccaatattctcctgctatgcagaactttgttcttgccgtttttttgctgttctccaaatttgttccccactaaaatagaaaccttcccttctctcctgtcctctcatttcagttctactcttcaattatcttgctccaccccctctagcccttctattcttacggcatttaatttgaagtaatttataatttactaataatgtgctaacttgggtacttgttttatcttcatcacatattctgcaacttgaggacagactgggttttgctatctttgttcatcttatggtgctttctcatgtctttttcactttttgttatcatatatacaggtatccctggctgtctgaactccatctgaatatctgctataatgacttgcaaaaattcttactcagaattcactctctgaattgaaaattcactatcacaaatatgcatgtacctgttagtgaaaacatttgtgttcaagtgtaggcaaaatatgtataaaaacagagagggggttagcctcccatgggccctttattagcttttgccaggagcctgggggtatcgttaacaaggttccaatttagatataatctttaacgtattatttcattttttattttcattgcggtatagaaggcaattataatttgtatctagtattttgtcatttaccatacaagcccaataatgagtcccttaagtgttatatgattacataattagtgctttaaatgctacataggagtttaaaaggttttgtactatatttgggggaactggttatgctttctggttgggctgacaacacactatttttctcatttaaaagaatggaacagaggtttttgctttccaaaagtgcactatataattcaggaatggactagagacaaataccaaggcatgcctgtatctaatttaagaacacaattccagagaatgacaagactactctcgatttgtgataaaatcttttcttccttagtggggcctaaagaaattatgtctgtgtaatgacttgccaaatgggacctgcccaggttttcccgtatatttatgcaatttaggatattaaccaatgggaatgcctcctgtggacccttgcccagggaagatcatgtggcgtgatcatagctccctgtagcctcaacctcttgggctcaagcaatcctcccacctcagcctcccttaagactacaggcaggtcccaccacatttggcggatttttgtattttttgtagagacagggtttgccatgttgcgcaggctggtcttgaactgctaggctcaagtgatccacccgcctcagcctccccgagtgttgggattacaggcatgagccactctgcctgctccagacttttcgtatgtccaagttgtttctcactctcagtgatctgggtttctgggttgaactgtaattgagaatactgcctttcaaattcagactgcaacctacagtaagaaatagcatcacaacagagtaacctcacacacacacttacataggtacacaatgtatatgtaaatatatggaatttatacatcacacatacatatataaaaacaggttaaaattcaagttcaggggtacgtccatgtgcaggcttgttacataagcttgaaacttgtgtcatctccgtgacatgtacaacaagttttgttgtacagattatttcatcacccaggtattaagcctagtacccattagttatttttcctgattgtccccctcctcccaccctccatcctccgacaggcccccagtgttgttcccctctatgtgtccatgtgttctcatcatttagctctcaattgttagtaagaacatggggtatttggttttctgttcctccattagttttgctaaggataatggcctccagctccatccaagcccctacaaaggacatgatctcattctttattatggatgcatagtattccatgctgtatatgtacattttctttatgcagtctatcattgataggcatttagattgattccatgtcttttctatggtgaatagtgctgcaatcaacatacgcgtgtgtttacatctttacagtacaatgatttatattcttttgggtgtatacccagtaatgggattgctgggttgaatggtatttctgtttttaggtctttgaggaatcaccacactgtcttccacaatagttgaactaatttatactcccaccaacagtgtttaagcattcctttttctccacaacctcgccagcatctgttaaattcatgttattatttgtgatatgctgataatttctattttattctattttcttctttaaaaaatgtttataatccaataaacttcacgactatgtgatttgaccttcaatttgaaaaacactgctttggaggatgaatatcctccaaatgaatacaatgaaaatgaatacaagaaagtactgtgttctatttcttttgaaagttgaaattctggccaggtgtggtggctcatgtctgtaatcccagcactttgggaggctgaggcgggaggatcacaaggtcaggagttcgagaccagcctggccaacatggtgaaaccctgcctctactaaaaatacaaaaattagctgggtgtagtggcgggggcctgtaatcccagctacttgggaggctaaggcaggagaattgcttgaacccgggaggtggaggttgcagtgagccaagactgcgccactgcacttcagcctgggtgacagagcaagactccgtctcaggaaaaaaaaaaagaaaaaaaagaaacttgaaattcttttgataagacttttatgaggatctttaatgcaaagctatctataggtattaaaaattactgggactgattaaaaaataaaactgttcagagtaacctttacttcacaccctgatcctatgctcttcttttacatttttttttttttgagataagagtcttgctctgttgcccagtctggagtgcagtgttatgatctcggctcactgcaacctcctgggttcaagcaattctcccacctcagcctcccaagaagctgggacaacaggcgttaatgcctctttaatttttgtattttaaaattcgtatgtccaagttgtttctcactctcagtgcctggttaatttttgtattttcagcagagacggggtttcaccatgttggccaggctggtctcaaactcctgacctcaagtgatccacctgccttgacctcccacagcactgagattacaagcgtgagccaccacgcccggcctcctctttttcatttctgtaaccttgtttttgtaatcagacttctccgcttagaattctgacttttctgttgggactctctgctttcaaacatgcaccagtctcatttatcagacagggaaggaaaaaagggaaagaagaaaacaccgccaccacatgcgaaaacatgtacaggcacataaacacacacacagaccccataaaacagtcttctgcaatcactctataactccttagagttatagactctagagtggttttagtagtctcctctgtatttgcaagcttgtatgagtgatttaactcactaggattaacatggttgttctgaatctttgtagattaaaactcaacacttctgaaatactaagaatgccatttcagtcatcaagcctgtttttcatttaattctgcagatagtactagataaaaggggggaaaaagcagtaacactaggaatctgaaagccttattattgaaaaagctaaggtaacttaaaactattatttcctgatttaaagatattctatttaagatgaaaaaaggaaccaaaaaaattatgctttctcttgcagtctaaaactactgaagtcaaaaattgggaataacattactaaatcataataaactcttccactataatatataataatacatgtattatatattggaatatgttagcatttataaaatttcaggtatttaatttttatattaggaaaatacagcagtaaagctataatgtatggcagacttcgactattttcattccaatctaacaaatataaccacaagataaaattccccatgataagaagtatatttggcaaaaagagaagaagaaaagttattcagagatgcaggagagaggaaagaaaaacctcattcactttgctatgtgacttataccaggttatcagcttcctaatctgtgagagacagtcttagaaatgtaattgtaatttaaaattctgaatagatgccacattcatatggatttttaaaaaacgcctttttctttctccagtaatgcaattaagcttacatgtttaaatgttttattaaaggcatattatcagttacattataattatagtacaaatggcaggtattcatactacttattttctgtaccataccatatattttagcacccaattatattaacttttacactcaatcattattgttttaaaggatttttgaactggtttctaagtattggctgaaagctccttaagaacacctttgtcatcatatactaaataccctcaggtaagaaataaaggttatattaatttggctgggcacggtggctcacgcctgtaatcccagcactttgggaggctgaggcgggtggatgacctgaggtcaggagttcaagaccagccttgttaacatggtgaaaccctctctctactaaaaatacaaaaattagctggacatggtggtgggcgcctgtaatcccagctacatgggagggctgaggcaggagaattgcttgaacccaggaggtggagcagctaaggttgtgccaccgcactctagcctgggtgacagagaaaaaaaaaggttatattaattcaataaaaaaaagggcctatattatttcatatatcatatccacataattatttatttattattattatttatgagacagggtcttgctttgtcacccaggtgggagtgcagtggtggtatgtcagctcactgcaacctcgacctccccagctcaagtgatcctcccacttcagtctcccgagtggctgggaccacaggctcgcatcaccacacctggctaattttgtttattttctgtagagataaggtctcactatgttgcccaggctggtttcaaactcctagactcaagtgatcttccctccttggcctcccaaagtgttgagattacaggcgtgattgtattttcctaatataaaaattacatacctgaaatcctatggcacctggtcccataaaatttatttttaaaataaaaaagcctcatctttcagcctgtagttatagaaagcttacctctcactgttctcctccattgtatcttgcattttagaggaaagtcctgtacatcggtcacctgtcagtttttcttcttctagacctattctgttcccattgtatttttcagtcattattttgtttggtgaatgatcaaaggcaggagataagtcttccttagaaagttctttccatcgtttctaggtagggaagagaaatgaaaaacaaatgcaaacattaaaaatttattttccttaaataaaaaaatttatgaattaaaatcctatattcaagttaagaaaacccaatgatgctaaaagatgagtgaaaaagaaaaaggcattttgccatactgtagcttgtaacaactatgcttattttaatttcaaaattttataataaagcatttagtatttatgtacatgagtatatagttgaatataataatcttaataaaatcttgtggacttttacctatttgagacaaactatactgggaccacactcaactattagtcacagtaatataattttaatattggtagccagatccatgaaactcgacagcacactgaacacattcaatgcaaagaggtcctctctccaaggtacattataataaagccatcaaaagtcagacatagagaattctaaaagcagcaagagaaaaggatcaagtcacatgtaagggaacctggcaggttgctattaacagatttctcagaaaacctgtacacgccaagaaagaacagactgtagagaatgggataatatattcaaagtgctgaaagataacaactactagcaaagctatctttcagaaatgaaagaaaaatggagtctttcccagacaagcaaaagctgcaagaatttattaccactagactagccttacaagaaatgcttaagggagctgctttgactggaagcaaaagtataattactatcatgaaaatatatgaaaatataatctcactgacagaggtaaattaattaccaaattcagaaaactccattgctgtaactgtggaatataatctttcaaatctccattatgaaggttaaaagtaaaaaatggttaatggtaactacagctacaagttgttaaggaccacacaatataaaaagatgtaaattaagcaacaaaattataagttgtggggggagggtaaaagccaaaaatattttatgagaccaaggttaagttattatcagcttaaaacactctaagatgtttaatgtaagccccagagtaaccacaaagaaaaaaagtaactacagcagacacacaaatgagaaagagaaataaatcaaagcttatcactatagaaaatcaccaaaccacaaaggtaaacaataagagagaaagaaaggaataaagaatatgaaaagcaaacagaaaacaattaacaaaatggcaggtgtaagtccttatctatcaataatacccttgaatgtaaatagattaaatacttcaatgaaaagatacagtggctgaatggatgaaaaaacaaaaaacaaaatccaactctatgttgcctacaagacactcacttcacctgtaaggacacactaagactgaaagtgaagggatgagaaatgatactccatgcaaattaaaaccaaaaagagaagaggagtagctatattttgataaaatagactttaggtcaaaaattgtaaaaagaaacaaaggtcaaaggggtcagttcagcaggaggatgtaatgattttaaatatctatgcacacaacactggtgcacacaaatatataaagcaagtattattacatctaaagggagacatagactgcaatacaataatagcaggagaacgctacatcccactttcagcaatggacagatcatccagacataaaatcaacaaaaaaacattggatttaaactgcactctaggccaaatggacctaacacacatttacagaacattccctccaacagccacagaatacacatttttctcatcagcacatggaacattctccatgatggaccatatgttaggccacaaaaacaagtctcaacaaattaaaaaaagaaaaaaatcacaatcaggccaggtgggtggctcacacccaagaactttgggaggtagaggctggaggatcacctgaggtgaggagtttgagaccagcctggccaacatggtgaaatgccatctctaccataaattagccaggagtggtggtgggcacctgtaattccaagtatttgggaagctgaggcataagaatcacttgaacccgggaggcggaggttgcactgagccaaaatcatgccactgcactccagtctaggggtcagagtgaaactgtctcaaaaaaaaaaaaaaaaaaaagaaaaagaaagttctcaaataaacaacctgatgtacctcaaggaactagaaaataataaactaaacccaaaattagcagaacaaagaaaataataaagaccagaagaatggaaataaagtgaccaaaaaaaagaaacgaaagatcaacaaaaccaaggatcatttttttgaaaaggcaaacaaaatcaacaaacctatagcagactaagaaaaaaaaaagactcaaatcagagatgaaaaaggagatattacaactaataccataaacaaagtattgtaagagactattataaacaactgtatgccaacaaattgaaaagcctagaggaaatggctaaattcttagacacacacgaactatcaaaacggaaccatgaagacatagaaaacctgaactgaccaataaagagtgagattaaatcagtaataaaaagtctcccatcaaagaaaagcccggacttgatggcttcatggctgaattctaacaaacatttaaataatactaattcctttcacactattcaaaaaactgaagagggaaatcttccaaaatcattctgtaaggccagcattaccctgataccaaaaccagacaaggacacaacaaaaaagaaaactacaggccaatatccttgatgaatatggatgcaaaaatcctgaatgaaataatagcaaattgaattcaacagtatattaaaaacatcatttaccatgaccaagtgggattcatccaagggatgaaaggatggttcaacatatgtaaatcaataaacatgatctctcaaaaatcaacagaatcaaggacaagaaccatatgatcatttcaacagatgcagaaaaaccatttgataaaattcaacatagcggctgggcgtggtggttcatgcctgtaatcccagcactttgggaggctgaggtgggtgaatcacttgaggtcaggcgtttgggactggtctggccaacatggtgaaaccccatctctactataaatacaaaaaatagctgggtgtggtggtgcatgcctgtaatcccagccactcaggtggctgaggcatgagaatcgcttgaacccagaaggcggaggtagcagtgagccgagattgcaccactgcactccagcctgggcaacagagcaagactctgtctcaaaaaaaaaaaaaaattcaacataccttcatgataaaaactctcaacaaattaagtatggaggaaattgtgcctcaacacaaagccacgttatgacaaacccatagttaatatcatactgaacatgaaaaagttgaaagcttttcctcttaagatctggaacaagacaaagatgcctcctttcttttttttttttttttttgagatggagtcttgctctgtcaccaggctggagtgcagtggcatgatctgcaacctctgcctcccaggttcaagcgattctcctgcctcagcctcccgagtagctgggactacaggcgcgtgccagcatacccagctaatttttgtatttttagtagaggcagagtttcaccatgttggccagggtggtctcaatctcttgacctcatgatctgcccatctcagccccccaaagtgctgggattacaggcatgagccaccgcaccgggctaggatgcccactttcaacacttttattcagcataatactgtaagtcctagccagagcaattagctaagagaaagggtattcaaattggaaaggaggaagtcaaattgtctctgtttgcagaagacataatcttatgtatagaaaaccctatagactctaccaaaaaactgttataactaataaaaaaaatcagtaaagttgcaggatacaaaatcaacaaataaaaatcagtagaattttatacatcactaacaaactatctgaaaaaagaaatcaagaaagcaattccattttcaaaaaaattacctaggaataaatttaaccaaggaggtgaaagatctctataatgaaaattataaaacattaatggaaaaagttgaagaggacacaaatggaaagatagcctatgttcatggattaaaattaatactgttaaaatgtccatactacataaagtgatctacagattcaatgcaattcaatgaaaataccaatgatattcttcacagaaacagaataaataatcctaaaatttgtatgaaatcataaaagaccccaaaagccaaagcaattttgagcaaaaagctgggggcatcacactacctgacctcaaaatatactacaaagctatagtaaccaaaatagcatgctactatcataagaacaggtataaagaccaataaaacagaagacagagcatggaaataaatctacgtatttacagccaatttatttttgacaaagatgccaagaatatacactggtgaaggacagtctctttgataaatggtgttgggaacactggatatctagatgcccaagaatgaaactagacccctatctctcaccatattaaaaaatcaactcaaaatggactaaagacttaaatatgagaccccaaacaaatatacatactagaagaaaagatagggaaacacttcaggacattggtctgggcaagggaagggtcttttgtataagacctcaaaagcaaaaacagacaaatgggattacatcaaactaaaaagcttctgtatagcaaaggaagcaatcgatagactgaagagacaatctacagaatggaagaaaatatctgcaaactatacatttgacagggattaatatccagaatatataagaaactcaaacaaaattcaatagcagaaaacacaagtaatccaattaaaaataggtaaaagacctgaatagccatttcttaaaagacatacaaagagccaacagatacatgagaaaatggtcaatatcactaatcatcagaataatgcaaatcaataccacactgagatatcaccacaccccaattagaatgactattatcaaaaagacaaaaaataaatgctggcatgaatgtggagaaaggggaactcttgtacacggctggtggaatgtaaattagtacagccatcttggaaaacagcataaaggttccttaaaagattaaaaatagaactatcatatgatccagcaatcccactactgggtatttatccaaaggaaatgaaattaggatttcaaaggcatatcggcactcctgtgcttattgcagcactattcacagtagtcaagatacggaatcaacctaaatgtccatcaatgaatggagggagaaagaaaatgtggaaaaaaaaaaaaaaaaaaatatatatatatatatataatataatactatttggccattaaaaaaaaaagaaatcctgtcttttgtggcaaaatggatgaaactggaggacattaagccaagtacacaaagacaaatactgtatgttctcactcatatgtggaatctaaaaatgttaatctcatagaagcagagagtagaatagtacctactggaggcttcgcagagtagggaagagggggcatagtgagaaactgaacaacagttcaacagggggatgagttctggtgttttactgcacagaatgactatggttaataatatttaatatttcagacagggtgtggtggctcatgcctgcaattctagcagtttgggaggctagggcgggcagatcgcttgagcccaggagtttgagatcagcctgggcaacatggtgagacccagtctctacaaaaatttaaaaattagccatatgtggtggcacgcgcctgcagtcccaattacttaagagactagggcaggaggatcacttgagcccaggaggcggaggctacagtgagcgagccatgatcgtgccactgtacaccagcatgaacaagagaatgagaccctatctcgaaaaaaatttatatacatacacattttatatacacataaaatcctctcttctggctatttcgaaatacttatatatacttatatatatttcaagtactatgaaatatattagcacataataatatataattaaatagagatttcaaaatagctggaagagaggattttgaacgttttcaccacaaagaaaagataaatgtatgaggtgatagacgtgctagtctaatttggtcattacataaatgtatcaaaatatcacactgaaccccataaatatgtacaattactaagtgtcaattaaaaacaaaggccggggcatgcggtggctcacgcctgtaatcccaacactttgggaggctgaggcaggtggatcaagaggtcaggagatcgagaccatcctagctaacatggtgaaaccccatctctactaaaaatacaaaataattagctgggtgtggtggcacacgcctatagtcccagctactcgggaggctgaggtaggagaatcacttgaccccaggaggcggaggttgcagtgagctgagatcacaccactgcactcctgggcgacagagcgagactccgtctcaaaagaaccaaccaaccaacagacaaaaaaacaaaataaaaaataaagtagcactgcacaaaaaacacaaaaatttttaaaaagatttcagccaaggtagattttgcttgaatcttaatccacttctaatccagaggtatgtaacactggagtagtcaccacagtggtgcttgaatgtgatctggaaccttcttgctccttgccactgttcagtctaggggagaactaacggtgagatctccaagctggtccttgtgatgctaaaggactttaatttggttgtgtctatcaggtacgctagcagctccaggcagctggctagcccaccactgggctagagaaacaccctccagcatgcctctagcatggccttcaggagtagatggcaacacaaaccaggattcggaccaagatgaagacaaatttcagtttcttctatgaaagaggatgtcatcatctaccctgggagacagttgtgattaatgagatggcatgtgaagcgcccagcatcatgtctagaaaatatgtttcctgtgctctcacttgtcaccattcctagggacaaaggtagaggaagaagagtgtatctgggcccctgcagatgaaagcagtgacaattgtacatgccagagaagaaaaacgcatatataacctatgcactgggactatagtctctcaagtccttgaaaggatgaaacatgatccccatctatgtatctgccagtggcaagtggtagaggcagaagcagtgggagccaatggttttgattacctatgactgacactggcccaaatgacttggtatggacagggatggccttctttgaagatcctatcaaggacgcaaggagtcttggatctaataaataaggaatactctacttattgcccgaggagtctaatgattttggacagagatgtaacattgcaacttaaagttttttagaacttatggaatattcattccctggagttactcttgtgcaatatggtactgttaaaagcaatgcttgtattcagatctttaaaaaatctctgggaaatccattcatacaatggataaactagtttctaatttgtctcattgtcatcatgtaccagaggtattaaaaagaaaaaggcacgcctggcacagtggctcatgcctgtaatctcagcactttgggaggctgaggtgggcagatcacttgaggtcaggagtttgagaccagcctgggcaacatggtgaaaccccatctctaccaaaaatacaaaaattagctgggtgtggtggcacatgcctgtaatcccagttacttgggaggctgaggtagaagaattgcttgaacccgggaggccgaggttgtagtgagctgagattgtgccactgtactctagcctgggtgaaagatgagactcggtgtcatggagaaaccctgtctctactaaaaatacaaaattagccaggcatggtggtgcaagcctgtaatcccagctacttgggaggctgaggcaggagaattgcatgaatctgggaggcggaggttgcagtgagccgagatcacgccactgcaatccagcctgggcaacaacagtgaaactctgtttcaaaaaaaaaagcattttccacacttcaccgttcccagatatggctattttacttagctgcataatcaatgtacctctttttatgtttttaatttttttagagatggggtcttactctgttgcccaggccagaatgcaatggtgtgatcacagctcactgtagcctcaaactcctgggctcaagcagtcctcctgtctcagattcctgagtagctgggactataggagagaactaccacggctggcttttttgttttataatagttgatttacagaagatttagaaaatgtgaaattctacagtttgttgtgtttggagaacagttagtagtacagtttggtacaatttgtctagaggatggaaaacacgcaaagcttgagtaggagagatgaggctggaaaggaaatagacctccgggaaagaggtctctggacttcatgagtagtggggtagaactgaaaatcctgagccctaagagggcgcaaaccatgtccccgaaagaatactgtgccaacaatcaagaaactacaatataatggaacacaggagtaattaaggatgtcttcacttagatgactgtctattttctttgttcccttgtttgttttgttactcaatccaaatcttttatagtgaagacatggagtacttgctactctccatgccatattctaacacttcaaatgtgctagctcttaatcctcacaataaccttaggagataagcactaatactaatattaccattattacaccctttttacggaagatgtggggagaataattaggtaactcgcccaaggatatgcacctaacaaatagtagagacagaattttaacctaggcaagtctgggttgactatgctgtgaccccttataaagatgtgtgttcaacaaagtaccccacaaaaatgttaaattgtctccagaatttacactggtcaatttttgaagtttccactcttgactgagacctagttatgtaacttggccttatagctggacaacactcaacaatgtcaacaaataagatgacaccaaaaatcaagtctcactggaccacttcccagaatatgcaacaaattcagaatacgtcaacaaggaaagcactcggcagagagagaaataaaagagatatttaatgctagtgaattaaaaaaaccccacaaacccaacaatgtcattttgccatggctatgttcagcaaactcactcatggctatgttcgacagactcattcatggctatgatcagcagactcactcgtgcctatgttcagcaaactcactcatgcctatataggttcagcaaactcactcgtctctgtcctccctgtgacacacaagggagccagcactcctgagtcacctgcctcaggtcattaatgctgactggtgaagccaaggaattacatttcactaaactataacctcaaaggagctctcattttgaggcctggtactgtttcatctttctttctaattctgtgctcacgttgcaccaacccatgagtcactgccactaggagccatgccccccacacaatgcctagaaccctagctctacccatttctctcactgaagaaagctttaagcaatgcaattaaacttcaaatcctctgtaatttgttaaaagtttatcatttacatttaatactttattagtaatatcaaattaccagctagagatcttacaacattagttctgaattgccaaactagatatttactctggggggttaactgtcatcatcaatactgggaatatgctaataaatatgtggtaataccagcaaccagcttaagtatttatgcctgaccttgtgctgaaaggcaattgcaaatagcctatatgtctataggaatgtcaaagtcattggaagttttctgtaaatgaatacatgctttaagattataattacacatatttacagacttaagatacaatcactttgggctgggtgcggtggctcacgcctgtaatctcagcactttgggacgccgaggtgggcgatcacttgaggtcaggagttcgagaccagcctggtcaacactgtgaaaccccatctctactaaaaatgcaaaattagccaggagtggtggcaggcacctgtaatcccaactactcggaaggctgagtggggagaaccacttgaacctgggaggcagaggctgcagtgaaccgagattgtgccattgcactccagtctgggcaacaagagcaaaactgcgtctcaaaaaaagaaaaaaaaaccagtagcatgtgtggtatgtatttattaatccaactttatcagtaatcacttcatatgccgatggtctaaatgcaccaattaaaaaagattctcagaatgccaagaccatttctgcagaaattaaccccttggaatgggcagcatgcttttctgatcctgagtacctgaaggataaagatgtttccaatatcctatctggaataggggcagaaaatgccttagaattgagagcctgaggacaatatcacaccagataaattaacagaaaaaaaatccttcctagccacaaactgcactgtcaaagactccacaaaaaagtgtgtccagaaaaactcatctctgtgataaaaaaagatccaccctcagataaagtatgtattctaaaactaaagacacaaaacttaaaaaaaaaaaaagcagtggtaggaaagacacaatccaaaggacaatacatttccctcccagttacccgtctcatcacagccaggaagcaggcagggaaggcggcatgcaggctgtgaaggcatggggaaatctgattgaactacttttctttttgaactccagatttaagttggtgaaagctcactgtgattagaaagggaaattttcctaatcttaaacatctgaaataacttttacttcacctaaatcactgatcactgccaaagtgaccctggcaaatccagtgttcccaaagtctggcgtctgaagcaggacatgttctaatgggctgagtttcccaaacattgcgtattttggctctgagtgccctaatgtttctgtgcattaagaatattttaatgctatttaaagatttggaaaaaatctttttaaataaacctttattctgacaccaatggtccgatctaatttacattcttatattggctagtaatcagagaaatgaaagtgctagtaaatatgttcacacatgagaaacataatgaaaagacagtcgatcttcttatattatgcatcaacttacagtatctgcttatgtccaatactatgtgattaaaccagacaaaaaatggagtctgtggttgtttctattttacattttaacttagtacataacacaagtttctgatcagtctttgaacttaggttctacaaatatgcagtaaaaatagcttaatgagaataaagccaccaaccagaagaatataacattttgctggaatttcattatatctgccataaatattcaagttgcttgttgttataaagtcaaatatcacataaaccaagtatcagtgtttaatgaaggcaaaagtatctcaagtttccagttactttaataattaaaagattaaccacccccaaaatgaaaaattcagtttctttaatgaaatcttgtttctacaagggcttttaagtaacacacaggatttaacctgaggctgagtatatatgaggaagctagctaaaattttacaattttaagacagccagctggatttaccacaaaaattcaaatacactctttgaaacaaagacaagggctcaagtggagtgcagttatttgatgctatgtgtatttaacaaatagatatgatttaaaacctgtatgaagtttacctgtatactagaatctccctttatacattttgctccttctattatagccatgtatgagaatctcagttgatctggggtctgaataagacccattcggtattttctcatgttcagtaacacttgttttatgttaatatcatctcctttttccatctgcaagaaaggcaaaaaatgagacaagtcttgttattggaacccaggaaacagaatcaatgcaagatcattgctaagatttttgctatgcattttctcctctgaaagaacaacgataatttaaccctccagctataactgttatgtacacaacaactatcccagcctactcatccctccccacatctcaacccctcaagtagttggaggactttgattctttagctgattcacaactgattccaaaccaatcatagtaatctcattccttctggccagtcattggttaaaggaaggatttataaccagttctggctagtataaggactatttttttttttaaaagtcatggcaggagtcaacctttctgctcattccccttccgcctccttcatgtctgcactacagacacgatgtctggatatacagcacccatctaacaatggtggaaaagaggccaggcatgatggctcatgcctgtaatcccaacactttgggaggccaaatcacttgaggccaggagctagagaccagcctggccaacatcgcgaaatgccatctctactaaaaatacaaaaattagctgggtgtggcggcgcatgtctgtaatcccagctacattggaggctgaggctggagaatcgcctgaacccaggaggcggcggttgcagtgaggtcagatagtgccactatactccagcctgggcgacagagcgagactccatctcaaaaataaataaataaataaataaataaataaataaataaataaataaataaaaatgtggtgggtcacacctgtaatcccagcactttgggaggccaaggtgggcagattatgaggtcaagagattgagaccttcctggacaacatggtaaaaccccgtctctactaaaaatacaaaaattagctgggcatggtggtacgcacttgtagtcccagctactcgggaggctgaggcaggagaatctcttgaacccgggaggcggaggttgcagtgagctgagattgcaccactgcactccaccctggcaacagagcgaaacttcgtctcaaataaataaataaataaataaatagaataataaaataaaatgaagaaagacggtggaaaagacagcaaaagcccagatccacgataacactgctgagctacagcactgctctggactactgacctagtgttagaatccccacacccaggctcaccaaaaataaaagaaaaaaaattgttgaagttatagttggcagggaacaggtgtcattaacaaaataatcaccagagttttaaaactttgatgtaacaatctaattttgattgaagtatactatatatacgcagagtggtaaagtaatacagatgtttagttaagactcaaccgttcccaattcctagctttcattagagatgcaacgtctgaaatgttcttccaagagtatcactccttccaagagtatcactccattgatcaagctccttgtgtgtgtgtttacaatgaaaagcatcatcatattaattcacctgggaatctactttgtgctggcagtcatggtggaaagcataagaatgctgacataactgcaatgaagcatagctacgttttacagaaacatcgaagagactaatacagggccttaaagtcaaggttaagaacaccagtcttgtgtcaagcgtggtggctcaaacctgtaatcccagcattttggcaggctgaggcaagaagatcacttgagcccaggaatttgagactagcctggccaagatagtgaggccttgtctctactaaaaataaaaaagcaaaaactagttgggtgtggtggtgcaggcagctacttgggaggctgaggtgggaggatcacttgagtccaggaggttgaggctgcagtgagcagtgattgcaccattgtactccagcctgggtgacagggcaagactctgtctaaacaaagacaaaaacaaaatccccaccagactgaataccaggacaagctaaactgcttaggttattgataatcttagaacacgctcagaaagcagaaactaagctgcagggactactgaaggagtagatggcatggaaatcaaagcagacagtattattgttgggtttgatcctataataagaggaagaagtaaagacagaagttaggagaagtataagggcaaacagaagtttcatgtatcccaagtaacgaaaaaataaaggtcctaaaaagagaagaaaagatctaggctgtatacaggctgggactgggaatgactggtggagaaagaattagccgttgggggcacagacaggaacctcaggggagtaacagtaatactgacatttatggaatgctcagaaaacatcagggactcttctaagtctccttaatgtattaattcattgaattctcacaggaaccctgtgaagtatgtctatcattatccctagtttttaaatttaaaaaatgagataaagtatctgtctgaggaggaaggaattcaatattacatatgaatttatatttgaaaaaatgtgggggagagacctattatttctgtaatataaagctaccaggaagaaaaacaccttcttagggatctctaaaatcatcatggatacattcctaccagtcatgaataagaggcagttgcaacggtggaaatgagatttttaggtttttccaaaagtagaagtttaagttgaaaaacctcagttctgggatacagcatcagagtttattcactgccagtggaagcaatttaaaaaaaaaaatcaatgagattaaaatgagatcgtaagaagcacttaccaaaacaagacaagtgtctaccagagagaaggtgccagagcgcccaatgcctgcactacagtggatcaccgcaggcccatggtcagggttcaaggagccagattctctcactttaaacaagaaattgagaaatgaagctggtgattcagggactccaaaatctggccaggtagtataatgaaagtgagatattgttctggtttcaccactctaaaaagtgaaaatcaagggagaagttagttctaacttttttcttttaaaaaactacttcagaaagatcatgtgttttatataattctttaaagccatataggctgtttatactatgatttttccatttgttttctgacaatcccatatacaaactagggaagattttctttagtggaaatttgtgatgtattaataatagctaacgcatacaacacttactattttggaggcctgttctaagcactttacttattaactcaatccacacaataatcctattaaagcccattttcctgatgaggaaactgaaacaaagggtaagatagtttgcccaaggtcacacagctggaacatggcagaaccaggatttgaagcaacctggggcagcctttgggttctcagctactaatctgttaccatacatgttaccaatattttctttaattcatgtatcatgaatgggctatttttttctattttaaaaaatttctgccgggtgcaatggctcatgcctgtaatcccagcactttgggaggccgaggtgggcagatcacttgaggtcaggagttcgagaccagcctggccaacatggtgaaaccccgtttctactaaaaatacaaaaaattagccaggcgtggtggcgcgtgcctgtaatctcagctacttgggaggctgaggcaggagaattgcttgaacctgggaggtggaggttgcagtgagcagagatcgtgccattgcacgccagcttgggcaacaagagtgaaactccatcttcaaaaaaaaaaattttttttctaccagtataattttacattctttaacattttcctttttatgaatttcaaagtttattttttaaatataatctcccgttcacatgattatcttttagattctgctacacaggcataggggagcaactcaagaattaatctaaagaaacgatctttatatttttaattggaattgctcctctaaattgttgcctttccccatggcaataatttccaatcctaaagctgtttatatgcttttgctgatgtgctaaagtggtttaccaacatgctaaatgtttcctgtctcttaagcctgcctggtattcactatcgcttcctggatattcctgatgatctgtatttctaactcattatgaaaatgttccttagctttttgccaattgccttttgccccaaggagcacttctctgctttatactcttcatttgtgtaaacgaagcagtggtcttccactaatatgtctttgtgcaatttttcagttttattgtaggaggttttttttttttgagggaggaggcatagaaacaatgtaaaaaaccttgatgtttaatggtttaacaactaaagattattattataatatcctgctcccaataaaaattttcaaaattagaagttagctttcgctttaaaaatataaattttcggccgggcgcagtggctcacacctataatcccagcactttgggaggctgaggcgggtggatcacctgaggtcaggagttcgagaccaacctgaccaacatagagaaaccccgtctctactaaaaatacaaaccttatctgggcatagaggtgcatgcctgtaatcccagctacttgggaggctgaggtgggagaatcgcttgaacccgggaggcggaggttgtggtgagccgagatcgtgccattgtactccagcctggacaacgagagcgaaactccatctcaaaaaaaaaaaaaaaaatccattttgcagtagaaattaagacttctatgtcccagactcagtatataaggtataatactaataaaatacagtgaaataaattttctaaaaagtacatacttttagtgaccttttaacatccagcattaataatttcaaatacagtgtgatccacaagttctcaatatactaaaagcaataaaaaatttctccattacaaattaaaatgatcatggtttctacgctttaagacatttatttttaaattaattatggtaagtgaacaaagccagactaaaggctatatactatactattccatttttatgacattctggaaaaggcagaaaaacagaaacagaaaccagattactggtttctggctgggggtagaggacaggactgactgtacacaagcaacacaagaacatctggggcaggggagaggtgacagaaccgatctatgtttctgttatgggcagtggttacatgactgaatgcactgtcaaaagtcacaacacgactgtacaccaaaaggaatcaatcttattgtaggttaaaaaaaaaaggtaaattaaatttattgcattaaaaaagagaattcaaaacattctaaaataagaagggtaaactctagtctccttttacaaagcagcaggtgggcagttaatacggcaacactgacacaggaatgagctagagaggtgggttcttgacagcggggggtgggggggatacagttaactcaaagtcaagttttcctttaaatgaggttaagattccagtggatgttaataacccactttgtttcttacttgctgcggccaccagcaggaccagactcagtctgtgtgggccttcatgtggtctgctttgagcaggggcctgcagtgctctgtgggctacggcccagtacccctacggggtcctgcgcacaattacttcatcaagtcctggctcaaacatatggttaccccacaatcttgggcaacagcttgctttctctttgcttgtatgattttggctcaaaactagtggtctcaacttttttcacattcaggtcacgctgtctgggatattggaagccagttcccagaaatgctcatgactatttgtataatatagtcttccccactaatagatttttgaaaatcagttgttgttttttttcccccctacagaaccaggacttttttgagaggttaactttgattaatttatccttacagaaacaagattaaaaaaacacagctttccaaaatcataattcacagttacaaaggaccacacgaaggcataagatgcatatatttactactctggtatagaaacattcatatgcatgactggatggacccctttccctctttttcacgcaggaaaaaaaatgagaggggaaaaaaagggttgccaaaggatacagagctaaaacgaaattcatctttattccaaacaaggtctgcatttagactttacaatttttggcaaactccttattttcaaaactgtggaagcacccttttcttctccttggtcaccgagtcacactacttctcctctggtccccagctgctgccctccacccttctcgctgcttcacccccctccctacacacacgcgggttgcacccacaattataggctgtccctgtctgcagccgttccacacatgcctgccaagttttctgtgtaaaactctgcattatgtatactacattctgcacaaaatgtcagtggcttgctgttctaaggcaaaatcccatttacatttttaaaagagaattctaaatttaaagtctttgaacagcaatgtcaaacttgcatatatgaagccaggaaaataacctgtgagttgagcaagtgtaacaacaggaattgttaggccacagcaatttaagcatatgccctgttcacagccttcaaatgcaagttaataatcatcataaatatataataagattatacattttccaattatcataaaaaatctatacagctctatgaccccaggcccaattactttcacactttaggtatatatggaaggtaccaagattttgtttctaaaagactttcactaagccccagttctgtcatctgtaaatagggttaataatactacttaccttacaaaactgttgttaaggaataaataaaacaattaatgtgaagtgcctgccatatccctgcacatggtaaatgcttaacagatactggatatttttaaaacaactatactcaccaattgcctttattgtggcccctagaaagctccagtcaattgtaaaactcaacacattttcaacctcttcattgggtatttcctctacacctaaagagtgacaaagtttgtcaaccctatgtcctaaccagatgtcaaatctgtaccttcactatcactgccttagttgagtctctcatcaatttttgccagggtcagcatgtcagtgataaatatttactgactgggattcattgtgaaaggcagatcaaactcaccagatcaggaggagtggcagaaacggctagggacaggcttgcattctcagcagagagaaagcaatatgcaaaggcatgccacccacccccaccaaggaattcacctattagagaagtctgtctgttagcacgaacaaatcctggatacccgaaggagagggagttagacaaggaggcaaggaccaggctgagctgggtcatggtcttgtgcactggacacagactttttttggtaaccaatggaagccacagaagaattcttagaggatggtggaaagattgcatctgtgttttacaacaatcactcaggtgtaatgtgcttaaaatgtactcttgtgtaatggcgggggggtaccaaggcagcagataacttccaaccccttcgaagttaaaaacctcattatggagtcaagatttacatagagagatgtattgaacaagcagtagaatgataaaatttaaattactgaaaaagtataagaagaatcatagctgttagggatcaatgtgtcatagatacatgttaggagagacctaagtaagaagtgggccacaggggttactaaggacgtgcagagaagagagaggacattctaggtagaataaactgtttaaactattttgaaccaaatcccagctaagcatcataataattagagactctcatcttgctaaatctttagggacagggaaatagaagacagtcagcattataacagtattcctggaactcactaaacgtaaagcgggccaacattacagaaatagtgaagggcaactaaaaagaaaaaactgaaagacaagtactctagatgaccttatatttttaaaatccctcaaaattatctccatagcttaagccacaggccacactgaaagccgagatgcaatctcttcttcaggggcaagagttcaaacttttagctttaagtaagtcactaaagggctcctggtatgtcattttgctgttccattagactggaggaggcgcagggcttgcttagacaacagctttacctttggacttgttaatagatacgtgtcagactcccttagatgcaaactggatctctgcaccccagcgactccaataaagacagagatctgcgtgttgagattggctatcagccccctactccatcatcactttttctcactcccattggttctttctttcttgctagtatccttttcaactactcccggttcctgttgtcccttccaattcattactgttacaaaaaggaaactgatcaactaaaaaggtaattgtggctcccgcaccatcatgatattaactcacttgatccttagagcaatcctatgaagtaggtacgttatcaccctcattttatagatgataaaacaggtactgtttatcatctatagtaaagtaatgtgacccaagtcactcagcaagaatggcagagtcaggatttaaacttgggctatctgattctagaggttatctacttaggcaaatgtaattctgcctctcatactgaaatgctactttatccttctaaagaataaagaatccctagttctaattaaaaattataaagtagaacacaaacaaattcttgctattatattgtggtatgttctaaacccaggccaataaaaaatccagtgatcatgtcattataccacacagttgctagcaactaaaacagagtggctggccaactcacatgatggcctcaactccagaaagatgcttcagaatcaataatctctctttacaacaattagcatcttttcaaaaggacttatccccatgtcaaaagttaggagatggccgggcgtgttggctcacacctgtaatcccagcactttgggaggctgaggcgggcagatcacctgaagtcaggagttcaagatcagtctggccaacacagcgaaaccccatctctactaaaaatacaaaaaattagccaggcgtggtggtgcacacctgtattcccagctactcgggaggctaggacaggagaatcacttgaatccaggaggtggaggctgcaatgagccaagatcatgccactgcactccagcctgggcaacagaatgagactttgtcttaaaaaataggggaccaggagaactaatgagatcagtctgtcacttattagctaagtaatcgatggaaaaattcctataacctaatggattttaactattattttttataatataaaatacggggataataagaatatttacactatctacactaactgaagactactggtcagatgatatatatgtgaaagcattttggaatctgataaacaaaacacaaaaatcattctattttattgttacttaaggtataatcaattctcaataaggactgtttcagaaacagggaaacacatctatgcccttcatctaaatcaattttaatgccataagcaaatgagtaattacctgggataaataccaagagaagatgattcagagaactttcagaaccttgtggaaatacagttctgtttctgggaatgaacaatgtacagctcagtccagtatcaaagagttattgatgtatctcaatgcagtttaagacacatgtaaatggaaagagttgggacaaaataaatatagtaatgggaatgtataaataaatctaagcattatcattcgtaattttgagcctttttaggtgactcaagagactgtataataagcttagtacggatgtcacgggaagctggacagaaggaaaaccagaacctaggcctcacgcacagagcatgcacctgtgcttactcaatgcagcaaaaaacacaagtgtttcaagggatccaccataaaagggactgccacacatctaaaaagcatgtatatatctcccttctctttaaggtttttttgtattgttagtgatcacttaatttacttaatggttaactaaaacagtatttcacttatagactacatacattcctaaagtcatatgaggctaaacattctcctattttcaagctatcacagtttctattagcatctcagaattactctcatttcattattttctagtttattctattacaacacaaagagggcaaaagaggtaaatggcgaaagggggagaaatgcctcaatcatcaccctggcaacagcaggttcataacccactatgtgtatgtacctcaaccaaggcccaaggaacagttcatatgtttctggggaagaaaaatgcaagtaaggcctggcatggtggctcatgactgtaacctcaacactttgggaggccaaggtgggaggatcgcttgagctcaggagtttgagaccagcctggataacaaggcaagaccccatctctattaaaaaaaaataagaaaattaggtatggtggctcatgcctgtaatcccagatactcaggaggctgaagtgggaggatttcttgaggccaggagttggaggcctcattgagagctgtgattatgccactgtactccagcctgggtggcaaagcaagactgtctcaaaaaaccaatcaaccaaccaaccaaccaaccaaacaaacacccaagtaaatgttcttgagaccacatgccacatttatacatgtgtgtgtatgtatgtatgtatgtgtgcgtgttacatatatatataaaacaccattttttttccaactcaatagggacaaatttttgtgttgtgaatcacttaacaatagctttgtaagttattttcttgactattttgctattcttggcagtcacaggtcctgggagctattgcttgctgggcatttactaaggtcaggtgctctgcatacacatcctcatttgaccttcaggacagccccggagggaaggcgtggtaacctccattttacagatgaggaagggatcagtgagggtggggaacaagtctaaagtacagctctactaagcagcagagctggatctgaatccaggtttgcctgattctaaagccctctctattaatcctcatgtatttctattaattaatttttaatccccaaatatcaaactgaactttgaaattcttagtttctactgtttcttcagagtcctcagaaagctactagatgcagacacacaatctaaaaacacgtgattatggctagatactataggaattatccaaatgcatgtgcttatcaaacttcaaatctaataataaagaataattctttaaaccatcatataaagtccacaatttcgggcaagaaaggtcttacattgatattttctaattgtagtagatgtactgtataatacgacttcacatcttctgacaagagcttcacactgaatcctgtttctttaaacagcatctcttggtcatctgttggccagtactgtgcacatttaacctaaatttagaaatatgtatatgatttttttttagtttatagacatcatgaaaccataaagttaaaaaatgaaaacaaaccagatatatacatgctatattttttcaagtacccaaaactaagaagtcactactatattctacgcttaatgtattttagtaagattgaaattttatagccgggcgcggtgactcacgcctgtaatcccaacaatttgggaggctgaggcgggaggatcacctgagatcaggagttcgagaccaacctggctaatatggtgaaaccctgtctctactaaaaatacaaaaactagctaggcgcgatggcgggcgcctgtaatcccagctacttgtgagagtgaggcaggagaatcgcttgaacccaggaggtggaggttgcagtgagccaagatcattccactgcactccagtctgggtgacagagcaagactccatctcggggagcagggcgggtagagattgaaattttataaagcattttttatgtgtgtgcagtcatcactgtaagccagttttagaacatttctctcagactcagaaatccccttgtgtcctattcccactccaagccacaggcaagcactgatccattttctgtctccataggcttttcttttcttttgagctggagtcttgctctgtcgcccaggctggaatgcagtggcgtgatgttggctcactgcaacctctgcctcctgggttcaagcaattctcctgcctcagccttctgagcagctgggattacaggcgtctgccaccacacccagctaatttttgtatttttagtagagacagggttttgccatgttggccaggctggtcttgaactcctgacctcaagtgaaccaccaacctcagcctcccaaagtgctgggattacaggcgtgagccaccatgtccggtcttataaggtattttttaagtgttcctgtaacttataaactaaaaaagccataggtatcatattcataaaataaaaataaatttatcattcttaaagcatgattacctatattttaacgtcatgggacattcactttatgtttctaaaattatcaaactcttgcaataattttatcttcaaaataaatgttgctggccaagcgcggtggctcacgcctgtaatcccagcactttgggaggctgaggcaggcggatcatgaggtcaggagatcgagaccatcctggctaacacagtgaaaccccgtctctactaaaaatacaacaaattagccgggtgtggtggtggacgcctgtagcctcagctatttgggaggctgaggcagaagaatggcgtgaacctgggaggcggagcttgcagtgagtcgagatagcagcactgcactccagcctgggcgacagagcgagactccgtctcaaaaaaaaaaaaaaataataataataataatgccttaagaggaaaataaataattttttttttttttaagagacagtgtcttgctctgtagtagcccaggctggagtgcactggggtgaacttggctcacttcagcctcaatcttctgggctcaagcaatcccccaaccccagctgggactccaggtgcgtgccaccacacctggctactttttgtattttttgtagaggcagggtctcactttgttgtcgaggctggttttgaattcctgggctcaagtgaccctcctgcctcagcctcccaaagtgctgggattataggtgtaagccctccaacctggccagaaaaaaaaaaattttttttaagtaaaatagaaataaagagataaacaggattaaagagaacgtgacaaataaaaaaggtaggcaaagaaaatccaacatacgtataataggaagacccaaagaagaacattaaagcaagcaagggagcagaacaaatactaaggactgtaattcaacaaatatttctttaacaaaaagtatttaaaaaattttaaaaagtacttgaagtcaaactctcaagaacacatcatgtacctgtaaaaactgacccagaatggccaattactaagacatatttttggtaaaactaataatatctgaagaaaaagaaaaaaagaattctttgggtagtgcagataaaaagaacaagagacttataaaggaaataagatgtccattagactttggtggaataccagaaggaaatggaaaaaaaaagttgttcaaagaatagcacatgagccaaggattttatatcccgccaaactgactttcagatattaagacagcagatgaaccatcactgacatgtaaaaaaatcagactataatgctcacaagtccctccttaggagccactagagaatgagctttagtcagaatgactggagagacatcagcaaagactgttgatgaatattaaataatgcttgcttgtagaactaagagtctacaagagatgtaagggagagactacagtttgtaaagtacaactcagaaacaccaggaagagaatgaaaaaaatattaaaaattgtaaaccattttcagtaattattttggtagcagatgatatcatgattatggttatatattgtatatgatatgggaagaaggaaatgagtcattacaagatagtttacatctctcatatctttgagaaccaggattcttggtatgaaaaaggaaatagcagatgtaagatggaaggggctaagcaacacttatagttccaaatttgaactgggaatatcattatgaactcttgaagtatgttatcttaacatatgcatattgttccttagcttttgtccactgaaaagccctaaaaacaatgaccagtccagttgcaatatatatccttatttttgctgtgatcttgaaatactgctgcccattaaaagaaaccaaaactccttagagaaatggctggttccaggtctgggcagcaagagtttgagatgagcctgagatgcagtcattacagacagcaaaaaaaattttttttttttgagacagggtctcgctctgtccccaggctggagtgcagtggcacgaccatagctaactgtagccttgacttcctggcctcaagtgatcctcctgcctcagtaccccaggtagctgggactacaggcatgcgccaccacacccagctaatttttgtattttttgtagagacagagtttcaccatgttgcccaggctggtctcaaactcctgggctcaagcgatccacccaactcagctccccaaagtgctgagattacaggtgtgagccactgcacccagccaaggaaactattaaaggtttgttaaaaaggactcagagctgggtgaggtggctcacgcctgtaatcccagcactttgggaggccgaggtgggcgtatcacttgaggtcaggaacttgagaccagcctggccaacatggtaaaaccatctctacaaaaactagctgggcatggtggtgggtgcttgtaatcccagttgctcgggaggctgagacgggagaatctcttgaacccgggaagtggaggctgcagtgagctgaaatcatgccactgcactccagcctgggcaacaggcgagactctgtctccaaaaaaaaaaaaaaaaaaagaggactcaggacccaacctaaagacattgctgctagccaatgacagggtaatttgatcaaaaataaggaaaataactgcaaaggagtaaaattaatccagtatgtccaaacccataataattcaacctctcctgccactctccaccagaaaaactcctaattggtcatctgttgagaacagatgacctcaatagggaatcaacttttttttggaaaactgcttttaagagaagtaatgacagaattggattatcatcatttgtaacccataatgaattaagaagctgaacactgaccaataatggctattaatgaaataaaaagaacaataatcagacattatgggtctcttgatgaataacacattacccaccacctctgaagtaatcttccccaaaataattaaacctgactcttgttaaccatctaggttcaaccaccataaacatgatttctaaattctggtggcagtgttatcttattaatacagtaattatactccaaaatgagagaaataaaatttgcaaatcatgtagtctacaatggtgctcaaactgacaatgtcataatccttgatttttttttttttcttttttgagatggagtctcactctaccgcccaggctgcagtgcagtgggttttgagatggagtctcattctatcatccaggttgaggtgcagtggcacaatctcggctcactgcaacctccacctcctaggttcaagcggttctcctgcctcagcctcccaagtagctagcattacacctggctaattttgtatttttagtagagacggggtttcaccatgttggccaggctggtctcaaactcctgacctcaagtgatctgcctgcctcggcctcccaaagtgctgggattacaggtttgaggcaccgtgcctggcctaatccttaatttttaaatgatattgaagatcaggaaaaacccctgtaaatgactatgctgatactgctggaaattctggcatgtcattgccacatctaattagaagtggattaggaaattttcatcatcattaaaaaccagcaattatgaaatgtagaataaagtaagaaatctgaagtagaacagtacaagatcttaaagctggaagaggacttattgacaataggtcaataaggattcctagggattccaaagatctatatgtcactgctagtccatatttattccattgtatttctatcttggagatgaaaggtctgcaattgttataaaaatacttaagaaaggaaaaggatacatgagtttttccggacagaaacactttgaccgctagcctttagcaattaaaggccaaaactaaggaatgaatattggccccaaaatgaaaatctttatatgctaatgatcacatacagtatactaagttgtaaatattaaatattactcaccgattctttctccacaatgcggttcagcatgacaactgctttggtcttctgctgccaaaccataagccagaaatggcagcatgtgttaggaagtggaccctgtgaagagagaggagagagagcagatgagggaagcagacagaaagagcaaggctccaggaaggccttgttaagtctgctcctgggatgttacaagacagacagcggacgggcttataagaagtaaaccaagacttccaatctacctgatttcaaaaacaggtctgtgttagttaggatttttggttgtaaatgatcaaaactgacttttattttctcaggcaaaaaaggaattgtgtaagatatcaagtggctttcagagttgaggactagagagacaaacttgggtaggaaccaagggttaagacacaagcaaggtcctgccccaaagaaagtcaacctgggatgctgctcttgataccgtcactactatctccttgcttttgctggcactgccatatgaaggtggctatagtattcatgtacaatctataggcaaatcagagacaaaatcacgagtaggagtatctgactgatcatgttctagctgcaaagaaggtagaccaaggaaatttctgtcctcttcatcttctacagccaagaggatgtgcctcccacacatcatagaaaatccatgagaaaaaagtctgtaccatcactggccagccaaccaactcaagtcaactacaaaaagatttctagaaaaagtaggaatcattaaagtacctgaaccacaatgaaactgttaatctacaaatgcacagtatgtacggcctcaatggaagagtattgggcagagttaaaaaggggcaacagtccatgttacaacaatgccatggggataaaagcaaaatatttcatgtatttccaattgctttcacattttaatgatagcatagggcaaaaggaagatctaataagagatgaaaagcctatgtacaaattttaacgagttttaaatgagaaggttaaaatgagatgtagttttgctacacctaaaataactatgaacatgcattcaactcacatggaatgtagcagagtggtatgagttaggggcagagtcaggagtgggggctagggctgcccagagcttcagacccacatacaacaagggggttaaagtggttctagactaaaagcattttttattttttgagatggtgtctctgtcacccgggctagagtgcagtgtcacgatctcagctcactgcaacctccacttcccaggttcaagagattctcctgcctaagcctcccacggagctggaattataggcacccgccaccacacctggctaaattttggatttttagtagagacagggtttcaccatgttggccaggttggtctcgaactcctgacctcaagtgatccacctgcctcagcctcccaaagtgctgggattacaggtatcagccatggtgcccagctgactaaaagcatctttaggcctggtgtactccttggtatgtagcagatactcaataaatattacttaaatgaataaaccaaggttaagttgtaaaaatgctagaagtctactgaggatcctgacaaactacaacctaatatttgagagtggcgttttcctcactcaacttatttttctattacttgatctacttctaaaacaaaacacagtctaaaggtaaaaacagcaatgaggaaatccccagtaaaatgaatacctttttctttaattaggaaaaaaaaaatggatgtagcaatttgccagtgaggttactccttagtgtatacacacaatcacaacccatgccattccactggtgattctaaagactaaataataaacaggaacacagctggagtcttgctctgttgcccaggctggagtgcaatggcacgacctcggctcactgcaacctctgcctcctggattcaagcaattctccctccctcagcctcctgagtagttgggattacaggcgtgcaccaccatgccaggctgatttttgtatttttagtagagacggggttttaccatgttggccaggctggtctcaaactcctgacctcaggtgatctgcctgcctcagcctccccaagtgctgggattacaggcgttgagccactacgcccagccataggtttttaaatcagaggaacagagattcacatctcagctcttccatttaccagcaatgctaccaatgttcttcatctgcaaaacagacataatacaccaaggaggtgacttttaaaaaaatactaattcataaaactcagaagaaaaagatgactgaagtaacaatctacaaaggacaatcagaagagctgggttactgcatctctagttttctgtatcctccattccaaacaacctgctagatgcaaggccaagagctagactgagatgcagtcttggctctttaagagcttgcaaaggtagaaggagaagtacttgtatgactaatggacacagttaagtagtacaagagtatgggcaaattaaaccatcaggtcttagggagcaggaaaggctgggaaggaaactacagaagagcctcgaaaaaggtcctaatacagagagggaatgcagaagaatgggagggagttagggtccactccaggccctccaagcataaggcaaagtgcatgaaagtttagggcatatttgggaaaagacaaatagatcagtgaggtagaagtggagggatgtagttggtgactacaccactagagtgacagggatggtgccaaggggagaccttaaaaagctgctgcaacaggacaggtgtaattgaagagagctctgaaaaaagcgaggggcaatagaagatcagaaagaacttggcagacaatgaggacagtctcaatcccaatgagaaaaataggaaggcagctaccttggtaaaaaagacagagaacatgcagactttgaaatccagtaaaaatatccaatagagacctgaaaaacatagagaggaattcaggagagaagaaaaagccagacacaggcttctgagttctcgcattaaatgggcagggctccttcaggacacacacagcgacaagaagttcaaaaacaattactaggaggctgggcacggtggctcacccctgtaatcccagcactttgggaggccaagacaggtggatcatctgaggccaggagtttgagaccagcctgagcaacatggtgaaaccttgtctctactaaaaatacagaaattagctgggagtggtggtgagcacctgtaatcccagctacttgggaggctgaagcacgagaatcacttgaacccgggaggaggaggttgtagtgagctgagattgcatcactgcactccaggctgggcaacagagtgagactccatctcaaaaaaaaaaaaaaagaaagttatttaatgtctctggatctccttagattcctcgtgtataaaataaaggtaatactatttaccacagagggttgtcctaaggtttaaattatacaaagcatgtaaaaacaccattacaaaatttttaactgttattatttcctattataatgtaaaattcataaaattcataatagggtttttatgaaagtctgttttatttaaacaatgcctgccacagagtaggtctcagtaagtctttgctgggtgagtgaatacccagtgaaatgctggcaccaagattccagcacaggtaccatgacagtagtctaccctatcttaggttacaaaggttgaaaaccatggtcttaaagggctgtagtgcagactggaggagaaaaaaaaaagctaatttagaatcttaagacctatgtttttaagaactaagaagagaacaaaaaaccagtaagtgataatggagaagaacagtacagagggagaaagggttgtgataagggatctagggtggtaattcttctctattttttaatgtaattagttgtccctcaatatacacaagggactggctccaggacccaacctgccccccacccactgcagtataccaaaatccacacatgtccaagccccactggtggccctgtagaacctgcagatacaaagagtcagccctctgtatgcatggatttcacatcccatgaataccgtatttccgacccgtttttggttgaaaaaaatttgcctgtaagtggactagtacagttcaaccctggatggttcaagggtcaactataggtatttcaaacagaaaataaaatttttaactctaaatagtagtttaaaatacaaatgcacataaaaaaaacttccaatattacagaaaggaataaaatggaaaattaaagtctctattcccaagctccacaaattattactaatggtatatgtatgattaacttatttaaccagtcccttacagattgcttgagtctgatgcgttaaaataagactgcaatgaacatgatcacatatgtcttttttttttttttggacagttttgctctttcgctcaggctggagtgcagtggcactatcttgcctcactgccacctccacctcccgggttcaagcgattctcctgcctcagactcctgggtagctgggattataggtacccgccaccatgcccagctaatttttgtatttttagtagagatggggtttcaccgtgttggccaggctggtctcaaactcctgatctcaggtgatccatctgcctcagcctcccaaagtgctgggattacaggtgtgagcctccgcgcctggccgatcacatatatctttatgtctgactgtatttctctaagtagactttcttggtcggtcagagtatttgaacactgagtattatacactttgaaatctctccttttctgacaggtgaaaggcccattccctggttactgaatggagcatttcttcatgtgcaaagtgtccacctttgattctttgaactaggagtttatgtcctttgccagttttttccatgggctgttttttttctttttgacttgcaggagctgtactacctcaagtaaaaaatgcattttagtttcctgtgaattgacgtagtataatagctcatagttacattaatctgcatatctttttacttatcaaatatttttctctttcaaataagtcattctgatttaagttatgttttcaaaaatctcaaatattatggtatatcttttgaatatttaaaaatctttagggggaaagacagccctgttgataatcaagtctttattacttgatgaataaagagtagctgtggatacacaaaaatctctcctactatctcagaatggaaggaagaatcatgcttgcacacaggtgtggctgatgcgctcagaggcaactgggcagaaggccacagggagcacaaggccttgtggctgggcctctggagcacctggtctcagcacccgctcaggtccttgaagacgaccagacaccatccagggcttggtgtactctctgaagatatatgcgaggcagggggagctacagaagagctgtccagggcctctggttttgccacagggtatgggaagagaaaagaagacactaagaagcataagcagcactctgtgtcagatataatgtaaggaacacaatctgccaaagaactggcctaagccatttcctaagaattttccttcacagaacgtgtaatatcaaaaataacttgccttttatcttaaatactcaaagcttcaaaaccttataatgtccataattcattacatcgtcagaaaaaaactgaaataccatttcatttccaaaagaagtcaagatatacttttacctatgatttaaagcagaacaagcacaaacacatcattttcagacatttgcgtggtatcgtattacttgcctgtgttaagatgtaactcctttgtgcctcttctatgtcaactaaactggcattaatataatcattctcagcattttgcagtttaacacgactgtgatcatctgaaaatagagaatgataaaccacaactgtcatttcaaaattactgtttttatcttcatattaatattctaggtatttataaaaagacagaagaaataagaaaaatgaattagcatcataatagagttgagacaaatcctaaactattctctactttttttgtaaggagtataaaatgcaatcttgtttattactatagtgctggaaaggaagcacttctgtttgtagcacattagccattgtgacttgaaaaatcgaccaggagtaaacatagttaaatgaataaagtacttaccttcctaaaagtaaaaggatcattcagattcttggtacctaagaattgattggtctacctacaaaacgataactggtctcaaatagatgagactagatttccgaggttactatatttcaacctcttcatttctcaacagataagaattccactatatttaaataaattttagcactgaactgtgtttaggttaaatgctgaaaatatttaaagacagttggaatattccaactgtattctttaaaagaccactgaagatacttcactacttagactctgttaacagtttagagatatttctagtttttaaaagtaaaaatctcatagattgagaatttatgctaatttaaatatgtgaaatacaaaatgtgaccttatacatttagatgggaaagcaagagaagcatgacaccaggagaaaaagcccatgaattaactcagaatcctcaacacacaactgccggatgcatatcactgaattataaaactaaaaacatggtgtttgatgtttaactctagagaatgcatactattacaagttgtccctctcaaagaaatccatactaaatagccagtctctccttacttttaaatgaaaaaactgtttatattatctccatatgaaagaaaatgtaaaatggctttagtttcacacatcaatttatctgagatgtttctgctggactgaacccaagacctctgtaaatattacatgtcatttgccaacaggaaaaactaagatcttgttatagtaaatcacatatactagtgttctcagaaagatgatgtcaacaagcacttttttttaaaaatcacttttttaaaaaacagtttaatcaccctttaactgttatattatgtaaaatagtaaaaaggtcagcaacttaattaaaataaagaccacatatctcctagacaacataccaaaaaaagaaagcctggttttagaaaactacatgattttaaaattaaagttccactaaaatatcacaccaaaggaatgtatttcctcatgttgtaatcacagaaagaacactaaccaaaggctactcatatctattgcacaactgaaaacagccatttagctaacatgcggtaggaatccataaaacccgggaaggtccacctcacagggtgctgggaatctggttaccccacatggcaccaccccacacccttgcccagctatgcaggaagtaaacctagagaaagaccttcagccagagtatttgatacctcaccctcaggactctgaactaaaattcactgctattttccttctatctgtaaaatatgcacgaggtgttacctcaatgctctataagcacagtaaccacacaccagaaaagcccagatccagtcctgggaggcagtagggaggagggcactacctgcagggcactgggtctgcagggctcagcccctggcagtggcctcgcttcctgtttaacattaatatacagagtcaacaaaagcaaaggaacggtgaattttctcaggaaaatttttttttattttgttatcagataatactaaaaaagaaaggtaatccttgggaaaactctatagctatttagaactgactacaaatgttatttgagcctgtattttcttctcaaggctgattaaaaacaaaactgaaatacctacatcactagatattattttaattcttctgttcttttaagaaaaacacatacaaaggaaaaatgaaaaacaatttaaaaaggaagaaatattaaagcaaaaaggagaaataaaactttaaaataaatttaaaatacattaaaattataaaaacaaaaattgaaaaagattaatataaaataaaaagtatatataactttttgatttcgaagaggcagtagagaaaaaaataaaacacatcaccttaaaataactattgcaaaagattgtgaatatacacatttcaggaagtgaaactatcaaagcctctttatgagaaactgtgactttataatttatactctttagtgatgataacaaagaagggcactacctcttctccaattaaggatcacaacacacggtttcgagtttgtgagagcatatacacaggttcccttaacaacctgagtcacaggtctcttttccctgcccagatactatcagtcagccccaaatctgtaaactaatcattaaaaaacaaacttttgacttctgaatgagaacacacagaaaggtacatcctttctcctcttccataggaacctctgacatgagattatcataacagcagcatcccataacctttgggctgtataagtaagccccaaagcccactatactttaccatccttgtaagtctggttatctcaccctttcctcttttaaaggatccagtaaagggagaaaaatgaagatagttcaaactcttttgcatgggataccacaaaagcaaccaaaccacacttcacaggaaatcttatttctcaacctctactagcactagtagcagaactatcaagaacatacacttttttttctacaggcatcatctgccttaattcttgtcactgagtaaatgaagaaatgcaatacccaaacagaactgtggtttataacttggattaaaattaagccaatttctgacaaggagtcccttcacctcctaccctcaaacagcatgttttctgagaaacagctccacctctcaagaaatgactagtgctagctgtggctgtgctgacaatacagattagtttcctctttcaatactgtcatcataagctttaaaaaaaaaaaaacaacccacagctttcaccaaatatatcattattgtaaagacatctccttttggaaagttttccaggtcaaacagaaaggagaatttgtattcattgtaactggttacaattcatcctgaacaggttaaatcacagcaaagatcaagcatccttaacttacaagtcaggcaagaagatgaccaattctaatagtacagcgtgaaccagtgacttttcccctttagattttcccattctcaactaagggtaatcagtacgttttcaaacagtgatgtccaagaactcaaagcattttctagatttgtcaactctcttcaatcctgcaagtaaaatagtcgaacaacaaatattatgcattctctctcataaatcgagcaatgaaccaaaaacaaagctggcactaaacaccaggtcaccatatactcccccatattaatggagaatacaaactttagtacacatagaatattaacatttcaattgtttgctctgcaaagaaaattctacttgatgaaaggtttccaattgaccacaaaaccaaccagaaccactgtctagaaccatttggtgcctacgacatgtcaggtttgtgtgacactcgtcactgggtcacctctctcagtcctcacagccctatgaagtgcatatgaatatggatcacacccatcgcactgtcactcagggaagtcaagtcatcacaagtgtaacacactagagcacaaaaatgaaacctagatttgtgcaatttaagagattacctatttcctgcattctgcattccatgtctccctgatccatccagttggtgcctttaccatcctttccatacatcctaaattcttgctgacatcaccttttcacgttgctctccactcaggtgtgacttccaactcctctctcacataaaccccacttctgtgccgatgcagtccatgacatatcttctctaactagacgctctgatggaatgcctccatgatgaactggtctgttccctgcattgaatactttcagcaatcatacacaatttttagtcaacaaacatattttaacctatagggatctaaaggtaagacattatttgtttgaagcttttaaaaaggaaaaaagaaattatattaagccgtgactctgagtactgatactttattgcataaaatattgtgggaaggagcttgagtagttgctacctgaataggcctagtgagatcagcaggaaggggaaattccagcagagggcacatcataaagaggaatgaaagggaatggtgtagcggcaggactggcagattcagaaaggctggcgagctggctagagagggctccccagacacattaagggcggaccctgaagggcacgtgggccgtgctacaggcacaggctctggacagggccccagtgaagttctttaaaggactggtataaacacatttgattttcatgaaaataactctcagcagcatagaagatggactgaaccaagaagaaggcaacttcatacaccaatacactgaaagcgtaatcaaaaggtgatgaggcctgaatcaagtagtggcggtgggaatgtaaagagtatttccaaggtagcaccatcacagctttgctaataaagtatacattgtttaggaaacatttggtaagttcaaccttttccaaacaatagtttactgtccttgaaatcatcagcgtctttcaacccatcatgatttcaagatcctaaacttgacaggacaatgtcactaattaaattctgattccacaaatctcctaattgaaaaagtcctctttaatctgtccccaagagtctgcaatgaaaagaatacctgagaaatgtctttacaaaataggtaaaattcattagtttggaaaacagacatttttcctctttggtagcttgtataaaataagacatactaatcttcactttaaaataatcagtaagtatctcaccatttttttttttttttgagatggagtttcgctcttgttgcccaggctggagtgcaatggtgcgatctcagttcaccacaacctccacctcctgggttcaagcaattctcctgcctcagcctcctgagtagctgggattacaggcatgtgccaccacgcccagctaattttgtatttttagcagagacggggtttctccatgttggtcaggctggtcttgaactctcgacctcaggtgatccacctgcctcggcctcccaaagtgttgggattacaggagtgagccacggcgctcagcagtattgcaccattttctttgaaactcagactctccgcttctaggagagttagagcctaaacaaattgaaggtggagggacttaggggaaaagatttaactttcatcacatccaaaggcccatgagacaccatgcaaacaatgcggaccaaatatctatattggtgatatagcaataagcataactaagtaaagtatatgagtaataaatgctaagaaaaaagagtaacgggactcacagcgctggggagaggggcaggttgcaattctaaacagggtggtcaggatgggccttgtggctgaccacccaggtgggtcacatgtaagcacagatgtggaaggggtcagtctcacggatattttagttaacagtgttccaagcacagagaacggcgaatgacttaaggtggtacatacctaacatgtctgagggacatgaagaatgtggctggagccacggggacaaagcggagaggagcagtctgcagtttaggttcggagagtcaagaaatcctgtactgattcatttctcctaaatttgactgtcagggaaaaaggactgctacttccattttctcagcgggcctacctagtagagtgtcataacaatttaagtcagcaagtattcaaacattgtttatatgatgaattccagaagattttcacatattcaaattcctacacctgctagaattttgttagaatgacaaatcactatcaacccattctgaaccataagcaggaaatgaaatgacgttaactgactttcttaagcgtaaactaattcggcagaaaggaaaagcgcagaaaccttcaggacttcttagtacaggtacctggaattttgcgacgcagatgaaaaacatgggtgaggggagtttgagggatctaaagatgtggattctgatctctcttttggctctaccaacctacatgattccagacgtagtcatgatttcccagaaaagggtgactactacttgagaaacactatcagcatcccagtcgccgacagtcctatgataaggggcactcaggggtctgttttcttgtctgtcaaaatcagtggctcgaatggaccagtccttcttgattattttcactgacaaaccctccttaataccctaagagggtattaaagtacaaaattccttggtaattcctattttaccttaaacatttaaaggaatttcagaattctacttgatcatgtatctgtattttaatctagaaacaaccacaccctcaccccaatcccgagtacagctgactgtcctggactccagcactcccccactgcacgcttccacagctccctccacccagcgtaagtgctctagggcagaccagcccacccaaggtgctgtggcttttaagaggggcctcttagggcaagattctgatcagctccgctggtggagggcagcaggagcacccaggcacccagtagcagccttcttgccacagttaagctctttgcagccagggacgctgtcagactcaccacagagccccactcctagcaatgcgctgtccagggcctagttccagaaggccatcaaactcagaagcatgaaaagacactgctacaatccacagaccttattttgatttctccagttctacaggcactcatttgtgtgtgctcagttctatgccattttaccacaaacaaattcacatgaccaaaacaacacatacctattccatcagcacaaaggttctgtgtgccccttggcaggcacactcttccccattccacccctaaccaccgatctgctctccctctcgagaattctcatcatttcaagaatgttatataaatggaatcatgtactatgtcatcattggaaactggattgttttcacccagcgtaagtcctctgagagctacccatgttgttacgtcaagtttcttcctttttattgctgagtagtattctgtgttatgaatataccatagttaaccacttacccactgaaggacatgtgggttgtttcgaatctggggctactacagataaagctgctgtgaatattcatgcacacacttttgtgtggacattatgactgcatttctctgggataaatgcccaggagtgcaagtgctgggtcatataagctaagtatacgttcagctttttaagaaactgccaaactattttccagagtggctataccagtttacattcccaccacccatatatgagatccagcttctctgcatttttagggtattgtgatctctttactttagctgttttagtaggcgtctagtgacatcccaccaccatgattttaatttgcattttcctaatggctaatgaagttttttatatgttcataggcttatctgccatctgtgtcatatcttttgcccatttcctaactggggtttttgtttctttttactgttacattttgagagttctatatatagtccagatctaagttctttgtcagatatgtggtttacattttctccaagtctgtactcatctttttgtcctcttaacagggtgttttgaggagcagaagttttttatttcgatttagtataaattattgatattttaaatgaattgtgctctaggtgtcatagctaagaactcttcatctagccttacatcctgaattttctcccattttcttatgaaagcttttacattatgatccatctatgatctatcttcagttaacttttgtgtaaggtgtgagatttcattttaaattgctttgcacctttgtcaaaaaatcagttcaccatatttttacaagtctatttctagattatgttccactgacttatgtatttatccctctgccactaccacactgttttgattactgtggttatgcattaagttttaaaactaggtagagtgattcttctagtttttattttccaagatcattttagccattttattttagttcctttgcctttccacataaaagaataagcttgtttttatctacaaaaaaacttcctgaaattctgacagaaattgtgttagatctttaggaacaatttgacactatgagtcactatagatctatagaacaatttggggaggactgattcactatgctaagtcttccaatccatgaacatggtaggcctttttcatttatttaggtcatcttttgatttcttttatccatgtgtttggtgctttcaacatacagatcctatatgtattttgttagatttattccaacatattccattttcttagagcaactgtaaacaacaatgtgtttttaatcttggtttccacgtgtttgttgttaatatacaggaatacaattggcttctgtatgctgaccttgtatcccacaacctcgtttaactcacttattagttctaggacattgttgggtagattctttgcaatcttctacatgtcatctgctaataaggtcatttttatttcttcccttccaacctgtatgccttttatttccttttcttgacttcatgtactggctaggattcagtacctcaagtttatatgtatttttaatttgtatgtttaaataattttaaaacttacagaaaaattccaagcacaaagaattttcttcccaagtcatgacagcaagttgcaaacatacctgattattccatttttttatcttctacaatgacataatcctacttactcatagtatagccatcgaaattataaaattaacagtgatactttactaacccagacaccattcaagttctaccaactgtcccaataatgtcctttaaacaaaaggatacaatctgttctttcacggtattttttaaccttttgaaactgtaagtcagttgttttatagtgttcctccatttgagttgtcagatatctatttccctatagatgagttcagtttgtatatttttggcatgttcatctcagaaagatgctaagtattcactgcatcttatcgggtggttcaggattctgacatggtatatctcatgactggtcatgaccacatatttaaggctggtgttggccagacttctccagtgtagaggtactattcctcttcttatatttaataagtattttgtaaagggatacttcaagattatgtaaataccttgttcttcaccaaattttcacccaccaactttagtatccatttcaatatttattagttggcaacctatacaaaggtagaactttccctatccctcatttatgtattcatttgtttctttacatcagtatagacacattaattcctattttattcaataggttgtaaccattatttattttcatgctcagattatcccaggtttggccagtggactcagcttggcttctacatccttctgatatgtcttcatcattttttgggcatgtctttatgttctgtcactacaagacattccaggctattcttacactttccctgtcgcagacgtggaaccagccatttctccaaagctctattctcctcctagtggagaataaaatttggtatcaaaagctaagcatgcccaatggctcatcagctatcgctgctctcaagatttcccagtggacagggataagaaatataggtatatacacatacctatgttcatatttatctgtgtatctatactcactgaaaaccatgcattcatacctggatacagcaatgctaacccaatattacaggcttctttttcaaggacattaccacctttactcacatgccttccacatgtgggcccaaccccaagtgctttatagatttaattattcagggacagagaaagagaaacttaatgatatctttaatactctctttactaccctatgacaaaactatgtacaagatttttgtcagtccaaaaaaaaaaaaagtttcatctgttaaggaattcacaatgtaataggacagaaaggtgaatgcgggaaattggtgagaaagagatgaacaggggcaagaaatgaagcatacaagaaatagaccaaagtaatctaatgcaaccctctataattcattcacaaatattctctagaagatctgacagtgagaagatccaccctctgcgtgaatacctccaataacaagtgtactagttcagagggttcgtttgtaggtttaaaacagctcttaagagctaatgctaacctgatattcaccagtgctattattcgctcatgaaccctagttctatattttgggcttaacacaggataaagaactcttttttccatgtaaaagttcaggtatctaaagtcagctatcatgctgctctgtttaggttttctctttccctgtctaatcaatgctagcttcttctctaagagttctagttcttcttccttggaaccactccagtgcatcaatagcccgcaggaataaattattaacatcataaatagctttgatttggctttgattaaaattaaagatttttttttttttttttgagagggagttttttttcgctcttgttgcccaggctggaatgcaatggcgcaatctcggctcactgtcacctccacctcccaggttcaaacaattctcctgcctcagcctcccaagtagctgggattacagatgccagccaccacgcccaactaattttgtatttttagtagagacggggtttcaccatgttgacctcaggtgatccacccacctctgcctcctaaagtgctgggattacaggcataagccactgcactaggccaaaactgaatatttaaaaaaaaaaaaaaaaaattgaagatagaactaaagaccctaacagtgagtgagaaaatcttttagtaaaaaagctgtcaacaacggattttgagaaggtaaagcactacactgacatctggtctttattttcaaactttaatgggataagaaaaaatgttagcaaatatttacataatagttaccataaaatttaacttaaatctatacttattcggattattattatagaactaagtttttatctaaatctgctattactaagaaagatgacaagcactttctggtaagtttaaaggtttctttttaatgatttgaaggtctatcatcttataattctaagactatcaaaatgtttcttaataattctttgacttgtctgcacatttctagaggggttatctacgaagcaattcgtatcatctatagtggtgatggttttaaaatatgtccacaattcactgatacttcctccatcaaactaataagagtattaagtaccctctccttgaacatgcatggccttagtgagttacttctcaaacggaatgttgtggaagttgtatgtgacttctaaggctaggtcacaaaaggcaatgaagcttctgccttgctctctaagaatgctcactcttgaaactcagttgccttgtgataaagtccaggtctcatagagatgccttgtgtaggtgttcctggtgacagcccagttgaggtcacagtcaacaagagtaaagaagttgcttcttcaaggtgactccagccccagcccccatttgaaatgcaattacacaaaagaccttgagcaagaatcacctatgtggggttagtcaacccctagatttgtgaacataataaatgtctcctattgttttaagccactgttttggggtggtttgttatatagcaacagataaaacttttatacttttattcctcttactgaaccttcctgctttggctatgaaagttctatagtggcctcataaacagattaaaagacagttaatttatttctttccaatccttatggcttttatttctcattcttgcttactgtactaactaggacctagagtataaggtcagggagacagaagtataatgttaagtataagtggtaagaatgaacacacttaccttgttcccaatatttttttaaaacaatgctttcatcatgtcatcattatgagtgatgttgttgcagttatctcttagaaatcttagaagttcccttctatttctagcttgctatgtgtcatttttaatcctcagcaaggactttaaataatctttccacacttattgagataatcatatggctctttctcctttgttactgtggtgaattataaaataatctaggccgggtgcagaagctcacgcctgtaatcccagcactttgggaggccgaggcagatggatcacctgaggtcaggagctcgagaccagcctgacaaacatggtgaaaccccatctctactgaaaatacaaaaattagccagacatggcggctaacgcctgtaatacaaactacttgggaggctgaggcaggagaattgcttgaacccgggaggtggaggttgcagtgagccaagatcgtgccaccgcactccagcctaagcaacaagagcgaaaccctgtctcaaaaaataaataaataaaaaataaaaaaggtattctaatgttagctacccttacattcctgaaataaacttaatgtgaacataatgtattatctttttaatacattgctatattcagtttgctaatcctttgttaggatttctacatctatattcacttgcattattatgaaacataccggtaaaaccagctggcccagtgttttctttgtggattttgtttattaatgtctttaagtggactcttcagactctacttctgcttgagtcagttttggtaaattatgtttttctaggaatctgttccattttttctaaaaaatcatatttactgccataaaattgttggcagtattcaattcacgctttctttgtatacctgtatttatgtgcccactctttctcctgatattgtttatatgcaccttctttctttcttgtttgattgatcgtgctcgatcttgacagagttgatcagtcttaccgaggctaacatttagtttagttggtcccttgtgctgtaactgtgatttctatttctgctcctttgttgttgttacttctttctgctttttttttctcattctcttatttttactctaaattaggttagacagcacattaattttaactttcatcttaaaatactgggctaggcacagtggctcatgcctgtaatcctagcactttggaaggccgaggcaggcagatcacttaaggtcaggagtttgagaccagcctggccaacacagtgaaactgtctctactaaaaaacacaaaattagccaggcctggtggcacgtgcctgtactcccagctactcgaggggctgaggcaggagaattgcttgaactcgagaggcagaggctgcagtgagctgagatcacacccctgcactccagcctaggcaacagagcaagactccatctaaaaaataataaataaaatataatataaatatttaagacaatatattttcattgcagtactgttttagctcctttacacaagttttgataagcagtattttatatattgtttatttttaagtttccattataattttgtcttgacccacgatttagaaatgttaaaacttccaaatttatggaaatgtttatctttttattaataacctatattttaattgcattaagataaaaaattatgagctataagataggaattttttttttttgagacagagtttcgctctcgttgcccaggctggagtgcagtggcacaatcttggctcaccgcaacctctgcctcccggattcaagcaattctcctgcctcagcctcctgagtagctgagattacaggcatgcaccactatgcctggctaatctttgtatttttagtagagacgaggtttctccatgttggtcaggctggtctcaaactcccgacctcaggtgatccacccacctaggcctcccaaagtgctgggattacaggcgtgagccacagcgcccagccaggcattcttaaattttaagatttacttgacagcctagtcaatggtccattttttacaaatagaccatgtcagtcctagaaaaatgtgcattttctaattgctggatatagggttctatgtatttttcttcttatattaaggttaataatattatataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaagaaaaaagaataatattatataaatctatttctttacaaatatcttgtcttattaagaagcccatgaacatggatttgtcaatttctccccaaaattctattcatttttgcttaatacatcttggggctactttattagctgcatacaaatctcagagctgatactgacatctgcattcaaagtagttatgccatttgctaagatcatgcagggagcgtgccgaaagcatagaagttttcccttccttcttccccctctagtaactcatttaaaaagtatgtttatttgagaatctttttgttttgtagagcaacaaaccatggactatgtaacctgacactaccagaatcatgagtctctgtgttaatttcctttaaaatctgactgtttcacatggatgaaccttgaagacagtatgtcaaatgaaataaaccagtcgcagaaagacaaatactgcatgattacacatatatttagtgtctaaagtaatcaaactcatagaaacagaaagcagaatgctggctgccaggggctgggggaagaggaagatagggagtttttcaatggatttagagtttcagttatacaagatggaaaagttccagaaatctattgtacaacaatgtgcatacagttaacaatactgttaatatacacctacaagaaatttatggtatgggtttttaacacacacacacacacacacacacacacacacacacacagattgtttcatggccagtgaaaagacatgacagttgactcaattgctggcactcccttttagaccaaatagtaaactgggatttctacctgtactgcaaataggaagatctcaaaatttggtggtagtctctaatagtataaagacgtttcccaaagtaaccattacaagctactctcttttcaaacaacgaagttcttgtccatctcttctacaatgtctcacagttaactgagacaactgaggcatctctaggttgtagcagattatggacctcttcaaatcctttcaattttcttccttttttgagacaaggtctcacattgctcaggctggagtgcagtggcacaatcacagctcactgtagtctcaaattcctgggctcaagcgatcctccctcctcggcctcccaaagcgttgggactacaatcatgagctgctgcacccagcccaaattcttcctaatttaaaatatcctttttcctttatgtttctcgtattcagaactccaaatgtagtttccatatgtcagtctgaggagtggtgccatagtgagtgtaaaagaatcatgttaagattgtttaaaaataaacatttccagaccggctgaatccaaatctagaaaagaaagatctgggactctgaatttttaaaaaattctttttccattcccctttatttacctagttcaggctaccattctttttcttaaaagccatccctgcctccttgggcagagcctcttctcagctccatcaatgcactgtcatatcttacaatatctgtaacatgcttatgtgttaatctcctcaagtataccataaattattcgatacatagcatagtatcaaacatgtagctggttttcaacaaatgttttctgaaccaaatcagcaactgtcaagtactatgtatagaaatgcatttaaaaaattttttagagacagtcttgctctgtcacccaagctggagtgcactggtgccattgcaactcactgcagctttgaattagtggtctcaagtgatcctcctgccccagcctcccaaatagctgggactacaggcatgcatcaccacgtcccagctaattaaaaaaaagttctgtgtagagatgttgcccaggctggtctcaaactcctggccttaagcaatcctcctacctcagctttccaaagtgttgggattataagcatgagccacagcacccagccagaaacacatttttaaattacataatgactatcagttggaaaaggtacagcaacaccatcccagcttttaaaaaatacacattcctgagcccctctggacttagtgaacgagaaccaccacctccactggatgagaataccactcacgggaaagaggttgttgagctggtatttgcagaaggagaactttgattgagatgggtcagagagaggaggggaagaatatttcaaaaagggaatgacatatttgaagccactgaggtattaaaaaccagtcacgctagaagaactccaagtgattcagttttactgaaatgaataatttctaggaaaatgggtagaaaagatttagagaggtgtgtaaaggggtcaatctccaaaaagcccagtatgataatgctaaagaagtttaactttttcataaaaattgtgcagcactattagagaggagagtggaaaacacacttgcattatacaaagattactccagataccatgaaaatggactgaagtgggaacagaagggaaacaaggagatgggtttggaggctactgtaatgacgaggaaaagcgtagtagggcctgaaccaagccaatgtgaacagagaagaaaacagatttgaaatacattacggaggctgagcacggtgcctcacacctgtaatcccaacacatcaggaggtcgaggcaggtggactacatgagtccaggagtttgagaccagcctgggcaacatgacgaaaccccatctctacaaaaaatctaaaaaactagctcagcatggtggcatgcacctgtagtcccagctactcaggaggctgaggtgggaggatcacctgagcctgggaggcggaggttgcagtgagccgagacggtgccactgcactccagcctgagtgacagagccagaccctgtcttgaaaaaaaaaaaaaaagaaaaaagaaaaagaaataggaatacatcatggaaatggaaattagtattagtgacgtgggaaatgaatgagggaagaatctgtttctggcttcagaaaatgtgtaaataacggcaccacttataaacatggggaaaaggagaaaaggcaggtgtggggctaaggccagtgaagtgtgtcagggaggaacactcactcagtgtatactgagtctgaggtggctacaggacacccagacagagatgatgacttggatacacagacctgtagacagaaaagtccacgactgcagatgagatttggggttataagcagagatggaaactaggcccacagcagatgagatcattcatccaagtgttacagtgagaaggagagagaaacagactcctgaagaaataaaggcaaagtgaggaggagacaccctgaaaataggggaggggccaaagaggaaaatcagaaaaattacggggttaggaaaaaaggcacggtcggctgggcacagtggctcacacttgtaatcctagtactttgagaggccgaggtgggccaatcacttgagatcaggagttcgagaccagcccagccaacatggtgaaaccctgtttctactaaaattacaaaaattagccaggcgtcatggctcgtgcctgtaatcccagctactcgggaggctgaagcaggagaataatgtcaaaagtcacagagaaggaaaccagtggaaagtctctcattgcatttgacaactacagctacagtgcttttagaataagtttcagtggggaggctggagaagaagcatgggctgaagtgtgcatggtggggagggtggagagacaaatggcacattgattcttttaagcctgtgtacaggtaagaaatgtccatccatgtaggtaagaaaggaagtgggggctggggtaggatataagggttgagacaaaagagagcgaaccatatttatacaaaagagaagaagttatgagatagaaagaggctgaaaacacacaaaaagcagtgatgatgaagagcagggcccatgaggaggatggggacgaaggattcggctaggacagagggaggggaggcttctctcctgggactttagggaaggataggggcaaaagaaagtgagtttccaggtgatagaacatgaagctaaggtggtgtttcctgatttttacaatttttatctgtagaattgaaagcaggacgatatcctgagcatggtgaggagctctgagagataatttactcggtgcagagctggaacacggtggcagtggggcagacgagggcatgaggacagcaaggcaaccccaagcccacctaacactggagtccacccaaggcacacgctcatttgcccaaagtgcagagaggatgaatgactgatttttcctaagttggagcttcacaaaatggtggaattaaaaaatccagagttattttttaaatataaaaacaacaagaaagttattaatagttaggttagaggacaaagtaatatgcttcactacattttttaatcgaaatttcaattcaatacatttccaacttcacaatacatgaaaaagtcaactaaagatcctgctgaagtcaaagagcaggtacagtgggagtaagcaagtgaaagctggaatgacagaaagtagccctcaaggcagcagagtttcagatttcagaggtgaagatgactaaaggtcaatgtcagcggagctgaacaggtctaggaactctagcgcaatgagccgtagttctttcccagagacatgaagtcacccaggatgaggaaggtgggaaggagagggtaaggagaaagacagtgaatgactgaagtcaggagaggagaggtgccaaggcggtgtggggatgtgctggccagcacaagccttggaagagatcatttccatttgcaggctgaagcatattggctcagactagaaaatcctgtggctacgtgagaagcaagaatgagcagtctctttctgagagatcaggagaacatggcttactagggaggcatgtgtggggagggagggggcaaagaagaagaagagtaaggagaacatgcactgggggctgctcccagcagagcacagctccagaggacaaccactgcatggtccgcaggagggaagcttggttctctcaaggctaagtgcttttcaatgagaaggcatacaggaagagcctggtcccaatgatgatggagggaggcctgataacgcatattttaaagagtctccctgcagccttcaactgcaggtatacaacataagtctaaaagctgaggagaaaaatcataagttttattgatgtatatacttgaggataacttaagttgcaaatgtttttactttaaaataaaacatctcaattccagttaaaataaaattatcagctgggcatggtggctcatgactgtaatcccagcactttgggagactgaagcaggcggatcacttgaggtaaggagttcaagaccagcctggccaacatggtgcaactccatctctactaaaaatacaaaaataagccgggcatggtggtgcacacctgtaatcccagctacttgggaggctgaggcaggagaatcgcttgaatccaggaggcaggggtttgcagtaagccaagatcacgccactgcactccagcctgggtaacagagtgagacaccatctcaaaaaaaaaaaaaaaaaaatcccatttagatcaattcgataaaactaattaggggactcaaatgtagtgtagtgcatccaataattgcaattacaacaaatatataaaaattaaaggcaacaccaggttagggaaggaggatccaagcaaggagactgtggccccagaaaggcagtgcaagtgaccctgtgatgggaatgctccactggtttgcatctagactgtggtggtgattccaggaatctacacgtgataaaactgcacagaacttacacgcacacacaaatgagtgcatgtaaaactggtgaaacctggatggactgtattgtttcaggttcccaggtgtgatattggactgtagttatgcaagatgttaccactgggggaaactaggtgaggggtatactcgatctttctgtattatttctcaactgcatccaaatctacaattttcaaaatcaaaagtttttaaaaaattaaaggcatcaaagcaaggtgtacaactggaaaatactgtcttcaaaactcatggtaacattagagaattattctctgtagctcagtgattctcaatcagagatttggaggcaggggaagggcacctaagtatcagaattactgcccacacccgctattccctgaacgcacacccacactggaactgccaccgtgatgagccacctgtttcagaggaagtgggtcaaatcttcaagtgtgctgcaactgaagaaaatggaaaaccactcttctagctacttgtctttaagaacacttctaactggtagtaaagaaaaaagcattaagagaaacatagtatttaatagtaatttataacaaacatgaaagattttcagagactgcttctcatttgatttgcccaaaatcagccaatacacccttcttggaaatgtatttggtcaacataagaaaaacattctattcatgtaagaataaaaataaggatttttttccagtaactgatggatttttcagtggtacatccagaccctaaatatcttatctataaccaatgactacaatgtatataaaggtatacagtctgtgtccttgaacagtgaaatggttcaacctacacaggagatcttagcaggcagcaccataccctagtcaacaggcgaacaatcagtaacaagcaaaaaccagaatgtgatcaatctgatactgtttttcaagtccctaccaacagggagccctaaagagaaaacctatgtttagcccactaaagtcaaacatagggaaatatgctgaagcacgaaggaggcccaatttaatatctgaataagctgcatgaatcagaacaaaaaataaaatcaccgcatgatgatgaatacaccaaagaactctagtattataattgttcacacaattgtgtgcgtctgtgtgtgtatacatcataatctaaatgtccaacaacagggaacttatgcaaaagagtggtatatccaaagccactgtcaaagcaattaaaaattgtttataataaaaaaaagtttacaatgtactgctaagaaaagagctacaaatgagtatgtggcaagattctaattttccgtttaaagtacatgtttatttttaaaaactccaaagaatataaacccaagttattatttatttttaaataagtttgttccttatactcttctctgttttctaagttttctacagcgagtacatactactcttataacttggggaaggaaaaaaaccaaactacaccaataactattttaagcaaaacttacaaaggggatggaatgatatgaaaaggaaatacatatggatattatatagacatctataattacaattattttaaagaaaggaaaactgtgcataagaaaaacaggttgtgggaaatacaccaaaataatggtgcctatgtttgaaggatgaaataattatgggtaattatttttccttccactattctacacctttaaattcttaaagaacgtgtcttacgtaaataggaaaaaaattactgtatttatcaacactgaccccaagccctccttttcactacatcctgcctcctaaaacaaaccaaaaaatacacatgcacacaaacccacaagtacttacatgggcttacatctctgtatctgtttcgatttctgttttctggaaacttggccactctatgaggatagtcatgggactcatttcgaatttccttaaaataacaaaaatatattttaatatccctcttaaattctccacagcaaaacttatcttcccagccagcgtaaaataacatgaagcacttatgatatgccaagtactatggaaagcacattgtttacatcaattaatcatttaatcctcacaatactaatggaaacgattttcttccccattatatctgtgagggatgaaaggctttcaaaggttaaaaatccaccaaagatcccatagctagtaagtggcagtcccagcattgaaccaaggtccttcagatgccaaagtctgtgctctagatctgtttacttactgctaattaggctctattcaacacctacaagcaagcatcaaacactttatgaagcagaattaatgcaatggaggtatctatggtcagccacatcatattcaaattctgactaaaactcacagcatctacctaaattttggagtttctacctgaaaatatttatttcttcatgttcacgctatttaactgttactttattttgaacccagaaatatcctcaaattttatttctatcatgtttgtcattacttctccttaaaaaaaaaattatttctagagccataaatgttcagcaacaagcctggcgcagtggctaacgcctgtaatcccaacactttgggaggccgaggcaggcggattccctgaggtcaggagtttgagacgagcctggccaacattgtgaaaacccagctctattaaaaatacaaaaatttggccaggtgtggtggctcacacctgtaataccagcgctttgggaggccgaggcggggaatcacctgaggtcaggagtttgagaccaacctggccaacaaagcgaaaccccgtctctactaaatatacaaaaaatcagctaggcgtggtgatgggtgcctgtaatcccagctactcgggaggctgaggcagaagaattgcttgaacccgggaggtggaggttacagtgagccaagatcgtgccattgcactccagtctgggcgacagagtgagactctataaaaaaaaaccccaaaaaaatacaaaaattaggctgtgcgcggtggctcatgcctgtaatcccagcactttgggaggccgaggtgggtggatcacgaggtcaggagttcaagaccagcctggccaggatggtgaaacctcgtctctactgaaactacaaaaattagccaggcgcgatggcaggcacctgtaatcccagctactcgggaggctgaggcaggagaatcgcttgaaaccgggtggctgaggttgcagtgagccgaggtcgtaccactgtactctagcctgggtgacagagtgaggcggaaaaagcaaaacaaaacaaaaattagccaagcctggtgacgagcgcctgtaatcccagctactcaggaggctgaggcatgagaatcgcttaaacccaggaggcggaggctgcagtgagctgagattgcgccactgcaacaaccagcaggcctgaggctcatcctaggcgccttcgggttctctgcatttcaacatagaagacattctgtaaggctatgtccgcactaagctctcactactgatgtatccagaatggccaggtttgatctcccaggaaacagtgttctaagaattcaagtaaatacagaaatgtaacagaaaccaaaaaaaaagcattttaataggaaaaattaaattatgcttttgctcacattattacatgtaagaaaaagcattttaaaagttaggtgccattttgtttatttgtttttatagacatagggtctcactttttgcccaggctgttctcgaacacctgggctcaagtcatctacctgcctcagcctcccaaagtgctaggattacaggtttgagccaacaccatcagccgagtatctgaagtttttatttatgaaacatgatgcacaaatttctaatatgaaacttctccatttttctggaagtgaatggactggtaagtacttttgcaagatataagacactgttattagcctgcacgtggaagagaaatttaattttatcccttccaaatggaaagttaattgacttaataccatttattggtttctgcatttatcagtaacacctgctctatcataaaccaagtttcagcacacgcaggagtctgtttctagatcctcattctacttcacagaagcatttgcttgcccttgagacagtatcaaattttagttactacagctttgtaatcaatgcatctggaaggcaagttgtcccctatttattctccccatttgcattgccgttcatgatattttaattaattttgtagttttcttcataaaggtatgctaaaggttagcataaatgtataataaaggtttattcttagatacctgataagttttgtcgctactgtaaatgggattaaaacaacaacaacaacaaaaacctattgaccattactagtgtataggaaagatatagatttgcagggaggggaggcttaaaacaacaggcagagcaggactccctccacttcttccacttctgtgatacacacacacccattttccacacttaaggccatctgtcaggtgcagatttctatttttagcccagagaaacacacttctttgtgtgcactatacaaaagagggtaaggcccccagtatagtagtagggagatttaaaatttacaaaacacaatacaacagccaagttcttggggttaagaaatacattcataacataaatacattttctcagctaataagatctcttgcattgagtccattctttcaaatctccaatattgttctactttataaaaaaaatttcagtgaacttacaagaaccaatatttcaaaaagcagctcccaaaggtgcatattagcgtttattccaatatcctctttctctttctttttttttttttgttttttgaggcagagtcttactctgttgcccaggctggagtgcagtggtgcaatctcagctcactgcaacctccacctcccgggttcaagagattctcctgtctcagcctcttgagtagctgggattacaggcatgcgccaccatgcctggctaatttttgtatttctagtagggacggagtttcactatgttggccaggctggtcttgaattcctgaccttaagtgatccgcccgcctcagcctcccaaagtgctggaattacaggcgtgagccactgcacccagccccaatatcctttctttcttactaaaggtaactgcttttgttttcagaccacaatgagcccagctgaaaactatttgtcccagcctctaaggtcctgtgacagtctggccaatgggaataagcagaaaccactgggttggggctgcaggaaaacgctgacaaagaggactggctccaggtacctttgtcctcactgctgcctgcctggaacataggttttgctgccgggggtgaggggtgggaacaggcaggagccatcctgtgacagcaaggtaaaatgcacattcctaagaaaggtaagcagaaataccagcattgagtcatgggtgacatcaagaagccacagtaacagcccttaagtctctctccagaattcatatcacatgagaaacataaactcctggttgttaaatcagctattgattaattttctttcccatgtagctaaatcaggtctgtaatatacgcagcaaaaccaaatctcaacagcaactagatctgacactgatgaggcattttcaggaatacccaagacacaaaaataaacaattttataagcacattgcataagcaataaaatatacagtatctgtctaaatggcattaggaaagcagacagctgagctattcactaggtctatcacataaggcaaagccagctctacttgtgttctggagctaaaaccttccccttctatcacagattccgaatgtttcctctgggcacagtggctcacacctgcaatcctggtgctttgggaggcccagctggaaggatcacttgagggtaggagtttgagaccagcctgggcaacacagtaagacaccagctctgccaaaaaatttttttaattagctggggatggtggtgtgcatgtgtagttccagcttcttgggaggcagagacaggaggattgcttgaactcaggagttcaagactgcagtgagctagcatcctgctactgcactctagcctgggcaacagagtaaggccctgttaaaaaaaaaaaagtttcccatcagcagtgaaacctgttaatccaaggtttctcagcctcagcactactgacattttaggctagctaattttttttgggggggggggggcaagtggggactgtcttgtgtattgcaggatgtttagcagcagcatccctggcctctacccattagatgtcagtggcacccctccctgcatctgtaacaaccaaaactctctccaggcattgccaaatgtccttccacagcaaaatccatcatgaacatatcccccaccaacacagtagagaaccaccgttctcatttaataccaaactagatctaaatggcaaggatctttgctttaaagtataatttaaccaaaaattttaaatctaattatttttaatatgatttttgctcaaaaaaagcaaggaataattgagtcactagttaatttctttcttagtggcaatgatccaaaatgtaggcaactcatagcacaaagatatctttcacagttacttataatgttgaaaggctttaaataaactaaatgtctaatgacaaagaaaagactggttgaataaatcgtggtacatccaagtgaatatcatgcagctcttttaaaaacaggccctcataccaaattggcagtagcataaactcacaatctcttggaaagataatatatgacataaacaaaggaaaaacaaatcagtaaatggaactgagctattattaatacacgctatttggtaaaaaaaaaaaaaaaaaattccacttagctccttagctgtatttgaaacttaaacacacatgtgcattgcctacattaagaccacacaccacctttttccaaagtagtctaatttttggaacattatgaaatggtccattctgatcaatggccttatagcttatctccatgcccaaagattttaaattgtaaacatacctactttccttttttttttttgagacagagtcttgctctgttgccaggctagggtgcagtggtgcaatctcggctcactgcaacctcagcctccagggttaaatcgattctcctgcctcagcctcccgagtagctgggaccacaaatgcccgccaccacgcccggctaatttttttttgtatttttagtagagacggggtttcaccgtgttagccaggatggtctcgatctcctgacctcgtgatctgcccgcctcagcctcccaaagtgctgggattacaggcataagccaccgcgcctggcctgaacatacctactttcaatgtgtttactttctcctattatttcacctcctaatattttcacataataacatttaatccctcttgaaatttgctttgagatatatatgcatggcttaaaataaggaactaaattgattctactatagaaataattttgctgggttcaaataatgctgggttgaaatgtaagagtaagattttttatattcatctagctactcttcatttcataagcagtaactgtgcctaaatggtactgtttaaatacagggactctcaaaagtctcaggacttctgcttaagaaattccaaaagtatacttcacataaagtcatcattatactttgtttttcattgcaacaagcctttcaagagaatcacagaattcagaaggatatctttaagcagacattcatagaatcctcaaactaacttggtgttataggatggtcttgaaagaaactgaggccaggcgctgtgagtcatgcctgcaatcccaatactttgggaggctgaggtgggagaatcacttgagaccagtctgggcaacacagacagacccccatctctattaaaaaattttaaaattagcaaggcatggtggtacacatctgtggtcccagctacttgggaggcagaagtgggaggatcacttgagctcaggaggtcaaagctgcagtaagccgtgatcacgccactgcatgccagcctggacaacagagcaagactctgtctttattaaaaaaaaaaaaaaaagagagaggcggggcacagtggctcatgcctgtaatcctagcactttggaaggctgaggtgggtggatcgcctgaggtcaagagtttgagaccagcctggtcaacacggtgaaaccctgctgaggtgggcagattgcctgagctcaggagtttgagaccagcctgggcaacatggtgaaaccctgtctctactaaaataaaaagagtgagctgggcaaaaagagtgagctgggcgtcatggcatgtgtctgtagtcccagctactcggaaggctgaggaacgagaattgcttgaacccaggaggcggaggttgcagtgagccgagataacgccactgcactccagccccaccccactcccaaaaaaaaaaccaaaaaacaaaaaactaaaggttaaaatgatgtagccactttagaaaaacaaatgctgaacaaagagttaacatatgaactagctattctactccaaggcacatacccaagagaaacgaatacatacattcacacaaaaacttggacacatatgttcatggtagcacttttaataatagctaaaacaatcatttgtccatcaactggtgaatggataaacaaaatggtatatatctatataatggaatcttactaacttagaagaagaaacaaagtaatgatacatacaacacagatgaaactttaaaacattatgctaagttaaagaaaccagccgggcgcggtggctcacgcctgtaaccctagcactttgggaggccgaggcaggtggatcacgaggtcaggagatcgagaccatcctggctaacacagtgaaaccccatctctactaaaaatacaaaaaattagccgggtgtggtggcgggcgcctgtagtcccagctactggggaggctgaggcaggagaatggcgtgaacccaggaggcggggcttgcagtgagccaagattgcaccactgcactccagcctaggcgacagagccagactcctctcaaaaacaaaacaaaacaaaacaaaacaaaacaaaacaaaacaaaaaaacagatacaaaagactacacatggtatgagaccaggacagggaaatctggagacagaaagtagattagtggttgtcaggggttgggatgtgggtgagaatggagaataactgtatgtacccagtctctccttggggtgttgaaaatattctgaaattaagatttagttccacagctgtgaatatactaaaaaccactaaactgtaccttttaggtgaattttatggtatgtgaaatatatctcggccgggcgtggtggctcatgcctgtaatcccagcactttgggaggccgaggcaaatcacgaggtcaggagatcgagaccatcctggctaacatggtgaaactccatctctactaaaaaatacaaaaaattagctggccatggtggtgggcacctgtagtcccagctactcgggacactgaggcaggagaattgcttgaacccagaaggcggtggttgcagtgagccgagatcgcgccactcactgcattccagcctgggtgacagagcaagattgtctccaaaaaacaaaaaacaaacaaacaaaaaaaaaaaacaaaaacactctgggccaaggcaggaggatcatttgaggccaggagttcaagaccagcctgggcaacatggtgaaaccacgtatctacaaaaaataaaaataaaaataaacacataataaataaaaataaagccaagcgtagtgatgcgtgcctgcagtcccagctacttgggaggcaaagctgggaggatcacttgagcccaggaggtcaaggctgcagtgagcagtgactgtaccactgcactccagcctgggtgacaaagtgagaacctgtctcaataaataaataaataaataaataaatgaaataaaaatggaactcctgtattaagggcatattttgccaatatttctcaagaaagactgaaagtgaggttttgcctcacactcaacagtatcagtacttttttttttgtcctcagatgttgtcaagatttttctgtattgcttactctttcagatgtacctcaaatttaaactttcttttggctgacttcaaaaaaaatacattatagatatgtgccaagtcttcatcggaactgggttagcttctccatttgagtcttccttgtcgcttaatagagtttcgcttcagtctcctctgttccctttcaggaatttctatcacagacttggggaagtgctctctcctaacgctcatttcgcacacctctttcctgagttctgagagatttttctcaagccacctcagtgttctgcattatctactctgctacttggtactgaacattctattttaacaattgtgtgttataactttaaaaactctttactgttctcagtttcttttcttttctccacctgctcttgtatttggacacctgaattacagctgcctctacctcatactattttgcatgccctcaatgatcttggggtgaatttttcgtttgtctaacaacatatgtttggtcatctttacagaaagtgaatacacacatcagttcttaacccacacctgtgtggccgcttacactgttcactatcaactccttaagtctcaaatatgtgggaaagacccttctctagtgtgaagtaatcacaaaggcttgttcttaccactgcgctttggtcacttcaatgataaatcagaaaacaacaacaaaagcttccagtgcatgggattacaagaccttaatagtcctgggaaattacacttatttgtcatagttgttgttttttgttttttgtttttttttgagattgagtctcactctgtctggactgactggagagactggagtgaagtggcgccatctcagctcactgtaacctccgcctcccgggttcaagtgaattctcctgcctcagcctcccaagtgactgggataacaggtgcacatcaccatgcctggctaatttttgtattttttagtagagacagggtctcaccatgttagccaggcttgtcttgaactactgacctcaggtgatccgcccgccttggcctcccaaagtgctgggattacaggcgtgagccatcaccttcatttgtcatagttttctactgcctttcttgctgtcaatttttacctctatttacacaattatgcctaacaactctttctttttaaaaacttcaaacttcaggccgggcgtggtggctcacgtttgtaattccagcactttgggaggctgaggcgggcggatcacgagttcagggagattgagaccaggtgatctgcccgcttcagcctccccaagtgctgggattacaggcgtgagctaccacacccagctcctgatttgttttaacaagtgaagctataaaacaaaggctcatattctgaattttaaagttttaaggctgggtgcggtggctcacgcctgtaatcccaacactttgcggggcccaggcaggcggatcacttgacattaggagtttgagaccagccttgccaacatggcaaaaccctgtctctactaaaagtacaaaaactagctgggcatagtggcacgtacctgtaatcccagctactcgggaggctgaggcaggagaatcgcttgaactccggaggcagaggttacggtgagccgagaacacaccactacaccccagcctgggaaaaagagagacgccgtctcaaaaaaataaacaagtaaaattttaattttattttacttatatttttgagacaaagtcttgccttgtcactcaggctggaatgcagtggtgtgatcacagctcactgcagctttgacttcaggggctcaagtgatccccccacctcagcctcccaagtaggtgggactgcaggcacaccaccatgcctggctaattttttatttttatttgctatgttgcttagactggtctcaaactcctggtctcaagcaatctgcctgcctcggccttccaaagcgctggtatcacaggcgtgagccatggcgcctggttttgaagtttttattttaaaaatctatattactgcaacttaatttccatcattatcggggtgaaatagttataatattttattaaataatgtcaaataatatttttagtatttcgtacatagctttgttctatgtatggcatacagaaaacattacatcgttagaccaaattctccctcgaactgctacgatgtagtagcaaataagaacttaggaaattgaaaaagaataatcttctgttaaattttaattttataaggtaggaccttaagataatcccaaattgataatgagtttctccttatgggctaacatacctaagtttctttctttatactttaggtctctaagtgaatcctaaattatatgatgaaaagtgttccctttgttagtcagatgtttgtgcatatactctctacaaagatgctcagaaaaggacacagtgaagtatgaagaatcttgcatactttgaaacaccattactttaggatggtaaaataaccacttacttatagcccttaatatgcctgccactggctggggagagaagatccctggtggagtaagttcttttcttcactacatttttttttctttgagaagctctctttgaggaagagagtttagagactaaaacagctcactgtcactgaaccctactgtgtgtcaggcatgtgctatgtgcttttatgtgtgttatctaagaggtggttacaaatgagaaaacagactcaacttccaagatttatactgcagttaggtagcagatacagataggaatccagtacttaactttagcatatatatatatatgtatatatatacatatacatatatatgtgtatatatacatatatatgtgtatatatatgtatatatatacatatatatgtgtatatatatgtgtatatatacatatatatacgtatatatgtatatatacacgtatatatatgtatatatatacgtatatatatatgtgtatatatatatatatatatatagagagagagagagagagagagagagagagagagagaaaagcgtgttgttttttttttttttttgagacagagtttcactctgttgcccaggctggagtgcagtggcgcgatcttggcttactgcaagctccacctcccaggtttacaccattctcctgcctcagcctcccgagcagctgggactacaggcgcccgcaaccacgcccggctactttttttgtgtttttagtagagacggggtttcaccgtgttagccaggatggtctcgatctcctgacctcatgatccgcccacctcggcctcccaaagtgctgagattacaggagtgagccaccgcgcccggcagcacatacatatttttttacttatatttacatatatttatatacatatgctccctatgtatacatggattacatggacttggcaaaaattaaaccgtacaaaagggtatatagtgaaaaagttaagtcacattctcctctccctcaatcctttcccttaggtgataactgtaaccagtgccttgtatattttccgagacattctatccatatataagccagactgcctgtctgtcttcctccatccaagtatccatcccaccctcacaaaacagatattagcatactgttttgcactttgatttttcacttagtatatattaaaagtacttccatatagataatgagttctttttaacaatttaatagtattcatcacttagccagtcatctataatgggacacataggttatttctaggttttagctgttataaataatgctgctatgaataacctttcaaagaagctatatcaatgtatactgtcaccaataatataagaaagtgcctgagcttcacctacacaattatattaatgaactttttcatctttgtctgataggtgaaaaatggtattattatagtcataatttgaaattgttattattgtgaaggtgaacagctttacctgtttttaaaagccatctgtatttccgctctctttttgatatgtagttctttacatattaagaaagtttagtttttgttatatattgaaaatatttaaaattttttatcttttgacctttatggtatttatgtcaaaaatttaaatttttatgaaatcaaacttaaaccttttttctctaggtttctgtgacatggcattaaaaaatcctttttcactctgttgattacaaaaaattttctccattgttttcttatataattttatggtttcatttcttttatgtttagattattgcccaaccgggactttactgtagtataaagaatgaggcagggcaggcatgttggctcacatgtataatcccagctctctgagaggtgggctgatcacttgaagtcaggagttcaagaccagcctggccaacatggggaaaccctgtctctactaaaaatacaacaattagctgggcgtggtggtgcacgcctgtaatcccagctactgaggaggctgaggcaggagaatcgcttgaactcagcatgcagaggttgcagtaagccgagatcgtgccgtagcattccagcctggggccacagagcaagactctgtctcaaaaaaaaaacaaaaaaacaaaaaaacaaaaacaaataaaaaacccacaaaaaacatagaacagaagcagttcccactgttacgaagttactccaactttctagggctaccctgattgatgtaccaggtcctttactgggactagaggggtacaaactctaggaatcctgtagccttacctcaaaccacaggaagaattcctagaagtactatgaagtaaactgtaatgagaaattgatagctttcagactataaaaccgttcaaatatagtgaaagaagaaataaaataattcagtatcagattttccttaggggaatgaaagcagtttgaaaaaaggttataaatgatcagtgacacgaaccaaatgaaactgacagagcaaacggcatattaaatcagacatactggatttgaaaagttattcattgcattcccttcctccattcctctcgtttgaaaagtatccaaccttgagccagtttctttgttttgagacaaacagtgctgggattacaggtgtaagccaccagcccggcccctgaaatcagtttcttgaccacaatttcttatcctagggatcaccaggtgggcctatgaacctactaaaaccacatgctaagtttgcgggggattgtatttgtgcggacatttcctctcataaacatgtttcatcttaaaggtgtctaaaggtatctatgatctttaaaagcaaggatttcactgttaagtcaaaacaacttcttgaaccattagtagtactgtaccgtacatagaacattaaatcggcacaacatttaaatacatttaaaatggcattacattcattcttaaaagctatttcagataatggcactgcagggcaatgctattccaattaagaatgtaacaggctggacgcggtggctcacgcctgtaatcccagcaatttgggaggccaaggtgggtggatcacctgaggtcaggagttcaagactggcccagccaacacagcgaaaccccatctctactaaaaatacaaaaattagctgggtgtggtggcgcatgcctgtagtccctgctacttgggaggctgaggcaggagaatcacttgaaccagggaggtggaggttgcagtgagccaagatcgtgccactgcactccagcctggttgacagagtaagactccgtctcaagaaaaaaaaaaaaaagcctctccctctccctctgcctcctctccctctccccacggtctccgtctccccacggtctccctctccctctctttccacagtctccctctgatgccgagccgaagctggactgtactgctgccatctcggctcactgcaacctccctgcctgattctcctgcctcagcctgcagagtgcctgcgagtgcaggtgcgcgccgccatgcctgactggttttcgtatttttttgggggagacggggtttcgctgtgttggccgggctggcctccagctcctaaccgcgagtgatccgccagcctcggcctccggaggtgccgggattgcagacggtgtctggttcactcagtgctcaatggtgcccaggctggagtgcagtggcgtgatctcggctcgctacaacctccacctcccagccgcctgccttggcctcccaaagtgcccagagtgcagcctctgcctggccgccaccccgtctaggaagtgaggagcgtctctgcctggccacccatcgtctgggatgttaggagcccctctgcctggctgcccagtctggaaagtgatgagcatctctgcccggccgccatcccatctaggaagtgaggagcgtctctgcccggctgcccatcgtctgagatgtggggagtgcctttgccccgccgccccgtctgggatgtgaggagcgcctctgcccggtcgcgaccccgtctgggaggtgaggagcgtctctgcccagccgccccatctgagaagggaggagaccctccacctggcaaccgccccgtctgagaagtgaggagaccctccgcccggcagccgccccgtctgagaagtgaggagcccctccgcccggcagccaccctgtctgggaagtgaggagcgtctccacctggcagccgccccgtccaggagggaggtgggggtcagcccccgccaggcgagccgccccatctgggagggaggttggggggtcagccccccgcccggccagccgccccgtccgggagggaggtggggggttcagccccccgcccggccagccgccccgtccgggagggaggtgggggggtcagccccccgcttggccagccgccccgtctgggaggtgaggggcgcctctgcccggccgcccctactgggaagtgaggagccccttccgggagggaggtggggggatcagcccccgcccggcctgccgcctcgtccgggaggtgaggggcgcctctgcccggccgcccctactgggaagtgaggagcccctctgcccggccagccgccccgtccgggaggaaggtgggggggggtcagctccccgcccggccagccgccccgtccgggagggaggtggggggttcagccccccgcccggccagccgccccgtccgggagggaggtgggggggtcagccccccgcccggccagccgccccgtccgggagggaggtgggggggtcaacccctcgcccggccagccgccccacccgggaggtgaggggcgcctctgcccggccgcccctactgggaagtgaggagcccctctgcccggccaccaccctgtctgggaggtgtgcccaacagctcattgagaacaggccatgatgacaatggtggttttgtggaatagaaagcagggaaaggtggggaaaagattgagaaatcggatggttgccgtgtctgtgtggaaagaagtagacatgggagacttttcattttgttctgtactaagaaaaattcttctgccttgggatcctgttgatctgtgaccttaccccccaaccctgtgctctctgaaacatgtgctgtgtccactcagggttaaatggattaagggcagtgcaagatgtgctttgttaaacagatgcttgaaggcagcatgctcgttaacagtcatcaccactccctaatctcaagtacccagggacacaaacactgcggaaggcctcagggtcctctgcctaggaaaaccagagacctttgttcacttgtttatctgctgaccttcccttcactattgtcctatgaccctgccaaatccctctctgtgagaaacacccaagaatgatcaataaaaataaaaattaaaaaaaaaaaaagcatagaacagaaaagtttagttttcttctactcaggaaagtgagagcttatattctttaaagttagcctgtggaaatgtatctcttcctcagttatcagctgctatgtcttaaattttacatgctaaactgattgaggatttagtatatggctaatcactcttatccaaagtaagggtggtattattaaaagttcagtttattagttggtttaaatatcctctgactctcaacagctttccattaagaaaaaactaccttaatggggcattaagttaaggaatagagagtagagaatctagatgaggatttccaagggaaacaaatcatacgtaacgtttattcaagaaagtgaagagcacactatgttaattttaatttcgcgtacccagaccttatctgtccatctctctggtttatctggactatttggagaccaaagggaagaaggggagtagagagtggacaggtaagaggacaaagacaaggtagctaaaagaacagcaggggactgagagagctgtaacagttctccaactgggaatcagaaattctctgcagagtaactatctggaaaaagtaaaaagggcttttaagattctggttggccaagcactgtggctccccagcattatggaagggtgaagccggaagatcgctttagcccgggagttcgagaccagtctggacaacatggtgagaacctgtctctacaaaacataaaaaattagccaagcatggtggcgtgcatctgtgcagtgagccgtgatctcatcactgcactccagtctgggtgacagagtgagaccctgtctcaaaaaacaaaacaaaacaaaattctggttaagggctgggcatggtggctcatgcctgtaatctcgccacttcgggaagccaaggtgagcagaccacttgaggccgggagttcaagaccagaccagcctggccaacaagaacaacaacaaaaagaagaagaagaagaagaaatttgtcaggcgtggtggtgtgtgcctgtagtcccagcttctcgggaggctgaggcaaaggaccacttgagccaggagttttgagtctgcagtgacctacgatcgtgccactgcactccagcctgggtgacggaatgagaccccttctcaagaaaaaaagaagattctggttaaaatcaagaaatcaaaaaagaggcaactagaaaagctaggagacaaacgcaactatctggatttccgtaattatagatatcagtaatctataaacacatgtcaaaggcaaaacaatatgatttctaggtatacattccccattggggcacccatcccaaggctgctttcccttcaagcagtggtctttaccttttgagggatcacagacaaatccactaagaaactgacaaaagctacagaatcacctagaaacgaaatacctgggaacacacgtacataaaatttagcagtttcaggagatttgcaaatacctttcaagtctgatccctggatcccagacactgttttaaaggcctcaagtcccaaaatgaccctacctattataacacatccactccctcctagccatcaaaattaagacgattccctctgtgccactgatctcaaatagatcataagaagaaagcactacaggtagtcacatgggtaaattagggcagtgctgaaacgagaatcagaaggactggatttgagtcccagttatgacactagcagatattgtaacatcagataagtcacaacactgtattggcccagtgtttcctcagccataaatgaggggtttggaataaactaaggtgctgacattttaaaagggaacagttttcctgtgtttactgaatatttactgagcatctaacatgtttcaggtcccgtaggtaggtggtgggaaaacaaagaaaaaaaaagaccaccctcaaggagctacacagaacagacaagtagacagttacaaaacaatgtggttcatattctaataaaagaatatagagaactaagaaatgagagaagggggagcatttaactttgcccaaggagactacggtctagtcttgaagatgtttcccaaatagatatggtaggcatggagtatatccaacacatgaagactccaaggtgtgagagagtagccaatcttcaagggaattcagagtttgtgcaaccatgtaaaagcactgagattagacagcaggcaggagaatgtgtaactagtaggcaagggaagtgttttagaataagacagctttgattcacctgcctaactggctgccccgctgtaagtatgagaagaacagtgtgcacttgatatctgacttctaaaaattagctgactcacaaatggtaaaaattgttctctagcaatatttgaactacaaatttctaataaagaaaaatggcggccaggcgcagtggctcatgcctataatcccagcactttgggaggccgaggcaggtggatcacaaagtcaggagatcaagaccatcctggctaacacggtcaaaccccgtctctactaaaaatacaaaaaattagcctggcgtggtggcgggcgcctgtagtgttggcgggcgcctgtagtcccagctactcagaaggctgaggcaggagaatggcgtgaacctgggaggcagagcttgcagcgagccgagatgacgccactgcactccagcctgggcaacagagcaagactgtctcaaaaaaagaaaaagaaaaaagaaaaatggccaggcacagtggctcatgcttgtaatcctaagcctttggaaggctgaggtggacagattgcttgaactcaggagttgaagaccagcctgggcaaaatagttaaaccctgtctctacaaaaaatacaaaaaaattagccaggcccagctacgtgggggactgaggcaggaggatgtctaaagcccaagaggtcgagactgcagtgagctgagatcacgccactgcactccagactgggtgacaaagtgagacccagtctcaaaaagaaaagaaagaaaaagaaaaaaaaagaaagaaaaaggaaaaaaagaaagaaaaagaaaaatgtggctgggcgtggtggctcacacctgtaatcccagcagcactttgggaggccgaggcaggtggatcacctgaggtcaggagttcaagaccagcctgacaaacatggtgaaaccccgtttctactaaaaatacaaaaattagctgggcgtgctggtgggcacctgtaatcccagctactcgggaggctgaggcagtagaactgcttgaacctggggggagcagaggttgcagtgagctgagatcacactactgcactccagcctgggggacagagcaagacttggtttcaaaaaaagaaaaatgaagtcagtcaggagttccattgtttataaaccctaattaatcaaccaatttccaagaggctgaggtgagaggctcacctgagcccaggagtttaaggttgcagtgagctatgattgcaccactgcacttgtactccagactgggcaacagagtgagaactctttaaaaaagaaaggaatttaaaaataaataagccaaattccttctgagccatcacttcttagaaacaacccataacatagcttttgcgattccccagttttagtcttttcctcagtaggcacacagactccattccttctctctgcctttctcaaagctcagcctgatgaagacagcaatcagcagtgacaaaaggaaaagccaaaaagggatcatgaacattactcaaaaagtcagaattaacctcacacaatcagaccaaattaaacttttccaactgcaccctttgttttgctgttcttgttttagagacaggatctcactctgtcacctagtctgtagtgcagtggcacaattatggctcactgcagccctaacctcctgacctcaagtgatcctcccacctcagcctcccaaagcgctgggattacagggatgagccaccgcctggccagcactctttcacgatcaattcttccacctgtgtgctcttggtcccattgactcttgctttctaagatttctggctccaacaatcatcccttctatttcaacctccacctctctctttaggttcatccctgcaatcacataaatatatcaagttgccctttcctcgtaaaaagtcattcattcagcacatattttcaagtgcttactaagcacctgatactgtgcaaagcactggcagtgccttcatgaaactctgaagaagtaataaaaaatataaactcagattaacagagtctgttctgctccaacccaataattcatttctaagaaacctcctattatcaaactcatgaaataaaagacacttttcaaaaggagcaaaaaggaataagggaccagagttccagactcaaaatactaaattcatttttcccgctagaatttcaacaaggtatcaagttctcctaccactaagcaagtccagcttttagttgtactcagtttttgctcaagagcaaagcctttcttttcccagctccatgagcattaccaaaaaaagcacaactcttcaaaaacattatcagaaacatcacccactgctgtgctaaacaaagcagaaagccaccttaaacacttttttcctactcaagctgtgttactttcaagatagtggtttgcttaatgcaaattgtgttcccgaaatcatttgctgctgtatgacatccaattcccgctatgaaaggggaagtcttgggatgctaaagaagtacgcaacaggggctcatacccagcatgggcaggtcaagaaggcctgccaaggaagtgagacttcagggatgagtaggaggcagtttaagcaagaaaggaaagagaaggggggaaagttgtgccaaggcaaagagaacaacatttacaaacgccctaaggggagaatggacacacacacttccaagaatacaacacagtggaaaagagggaggaaagtgataggggaaatcaagcaagagacacaggccatgaggtcttgtgagccggaggaggggctgaatttacactgtgagcaacggaaagccgttcaagggtttaagtgagaagtcacacaatcttgcttcattttagctacctctccccacttcttcaagttgggcttctaaaaagagcagtgtacacttggtagtttgcatttcctcctaccttctctcctgaactccaggtatctgtcttgtgtagtccgctgacacaactccctttaaggtatctgttaatctagctgctcaatgtcatggccctctcaggctggcccttacctgtcaggtggccctgctcaccctcaactccctccactgctttcctccccacttctgtggttgttcctcaccagtcttttttgcaagttcctctttctccacccatccttttaaatgttgtctgtcaagattctgtccttggcctttgatatttccaaacgctctgtatcttccctagatgatctcatcaatgtctaagacctcaaatatcacccatgtgttcatgatttccaaaatcacatttactcagaccctctctcccgaactccaaatttatacattcaactagcttcatttcagtgtctcgcaggtacctcaaacagaattaaagtttcaaaaccaaacttgtacataacgtatacccctttaccatttcatttcaaatctgtatctcccctccatccctcctgccactgcctaacagaagctcatcatgtctcttcaggtttactccaaccgactactgccctgtgctgcgtgcctacactttcctcatccagtctgctagcagtcagaacgatcttgctaacaagtaaatatgatcagcccagagcagtggctcatgcctgtaatcccagcactttgagaggccgaggcaggcggatcacctgaggtcaggagttcgagaccagcctggccaacatgtcgaaaccctgtctctactaaaagtacaaaaaaatcaaccgggcatggtggtgtgtgcctgtaatttcaactacgcaggaggctgaggtaagtgaatcacttgaacccaggaggcagaggttgcagtgagctgacgtcgcaccactgcactccagcctgggcgacagagcgggactctgtcaaaaaaaaaagaagcaaatatgatcatggtatttccagacttacaattccacaatgagttcctattaaacagctcaaattccttagtctgatctaggctctgccttactctccagcatctcaacttcacaccagtctccaggctaaactgtgggtggttctctcagcattccctcagtgcctttgtgcactccctccttgctggaacagtaattctcttcacctcccttgtcctcttcccctggccaatgtctttcaagacttaggtgaggtcctccctccctcgagaagcttcaccagaactcccatgtgtacccctttttgggaaatacaggactcctaggtaactcaactccacaagaccctgtgcttcaagctagctttacatgtatcactttaacgttttcatcagcttacctatttacagggctgcatccttaaaaactgggactcctgtcttttaacaagaatcctcagtgtctaacactagcacataacaagcatgttatgaacgaatgaatgaaaatatggaactacaatgaggccccaaaagaataagccctagagtgagcacctcgagggtaggaaacttgccaggagcattctctgctgaatccccaaggccaggagcaaaagctgcaactccactgggggtccgggcatatttgtggaatggctgaatggatgttctaaggccacaggagaacacatagctcaaacttcctgacttgctttccattactaactttcttggtttgtgacctacttttactgtaacaccagtgtgcatgccatggtttctactgaccaaactaatggtcttgttttcaactaggaaaaaataatatgagcattgaccaaccaaggaaactacaggattcctcggtaagaatctatagaaggatttccttatctttttgaaaatgcatgtgaaatctccagtggatgcgagttaagttcatttttctggaaagaggaatcacaattctcattgaattttcaaggatattaatgataccaaagaaaattaaatttcttaaaccaaaatgttaagctgaattaagttatattcacttttctcttttcaaatctatttcgatatataacctatcccttagagagacagcagcctctgctaaaacaaatgtaactggagaagatgcagctggcaggctctctcacatgaagattcctaccagaatttgcgtttcagattgtctataattggaagagtccttaccagcattctttaaaacttagatccctattctaacatactctgtatcatgggaatcagaatatttatacttcccactaatgtgttcaagaagaaaacgttactttctgaacacatttttcactgccatctaattaaatggaaaggggaaaaacccaggatcatccatttacaggaaagcccgtcttttactttacacagagagaaccaaacatcagaagcagcattaacttaaccgtcaccaaattcaatcttgggaataatacgacaaggattaaacgaaggggaaagcagttacatcattttaaaagagataaagttttgtttgaattaaaaggtagtctagttgacataaaaaaagcgaatcacaggtgtttatactacatattgcatctatgtgagctgaacaggcacgattagggcgataggcatcggaacaccgtgcccccggggaggggatgagggcactttctcagggcaaggaaaggctattttgatttgagggggcttgcaagaggggattcatttgtgacacccgtctgggagcacacatgaaagctgcgtttcactgtagggaaagtatacctcagtaaggaaaactataaagagaatgacacgctatcactggacgaacacaagcaaagcctctttcgttccgggaaggttctatgggggccgaacccacgctgggcgctgctgggccacgggggaaaatgaagacggagggtcccgagagcgctgccctcgccagaggccacgagccacccccaaccaccgcggctccgccaggagagcgagcttcgcctcgcagagggctgcggcggccggcccggcgcccagagcggcctgctcccacaggtcctgcgcgggcgccagctggacccggacgccgcggcccggctcgcccgcccccgccctcaccgctcccggggacgccagctgcccacccggccacaaaacacccggccagagaaagagctgtccgcgagcaagaaccaagcacagcggcgtgggagctacggcgaagctgcggcccgggggcgcgcgcccgagcgcccccacggctttcccaaggacccccagacccgggccgcgcaacgctggtggcgcatccacgcgctccccaagaagccgctgtggcaccgccctccagaactaactgcgcttgcgctaaccatgagctgctcagctcaagtatgctttttttttttttttttttaaaccaaaaggagcaagagagcggtcagcgcaggcgcgcccctgacgcggaccgcgccgccacttccgccccgagcgagaggctagaggcgagaggcgggggaggcgggagggaccctgcggacagggcacgagtccgggtctcggaggaggtcggcgactgccgcgtgggtccgcgactcaccaagtacagcggctgccagcgacgctgagtatccaactcttcgaactcccgctcgatggtggtgggcatggctgcgggagcgagctggcgcgagcagagcctgcgccggcggagaggctcaggccccgcacgatccggggagagcgctggcgctgcggcgcatgcgcgctgcgcgccgcgccccgcccccacgccaagccctgtcggccgtggggaaagtacctggagcgtcggacgtcagcgcgcagactcggcgcccgagc

SEQ ID NO: 391 - DNA, 77959 bp, Homo sapiens
  source 1..77959: mol_type = genomic DNA
acatgagaggaagaggtctttataaataactcctggtttaaatggagctgaaaataggaagacaaaagaggaagccaattgctaagcacttattgagtcaataacattggcttggaagccatagtgcaagtggctggtttggtttatttccttctcatcaaaagagctaacgcaggattgaacctgggggcaccaagaccgcatgtgtgtccgaggatgtgtctgaaaggatgtggtgcttctcagatgatgatgtctcgactaagacataacccaggccttgggttagatctctcggtgtcacagaagaacctgtcgggtggtgtggcttggctgttaagtccctggacctcttgagatcactttcttcactggaaggtctagtcactgggttggcttctaagctctgagatttagatagcaattcatagctaagtcttcgatataaaacacaggaaccaaaagtgtgaataaaatcttgactgtgctcaagtgtcctgtgaagtgtcctgtctccactctcaattccattctctgtagggtcttccttcagctgcaacaagggcctgcagtttgtgctctctctcggatgacaaaattgggtggaaatgtgctttattcacttgccgtccccagggcccctgatcttggggtgtggcccagcagcatgctagccagggcaggtggacgcactgggcggatgcaccggtgggggccaggccaggaggctcagcacagagctgactctgccccggttcctaaccctgcctccctaccccaggatccaagtacagagctgaacaatggagggagagacagcctgaacgccaggaccccacgctgcccggttcggggctcccagttccaccaggagggacagcaggagagggggcgccgcttgccgggcagcctggctggcagccatcagcagcagctgcaggtgcccgtgtgcacgcggaggatgcctcggctgtgcaagtgcaggaagttgaagatctcagagggcatggcgtggaagccgggacgcggcttgacgttgtcatagtagtggtgagtgatgtagaggcccgaggggttcatggggaaggcccagaagccaaagaggtgcacctcctcacagagctccagcgccgcagtgaccagaatgaggccggtgctgatgcgcttggcgcgcacccccaggctgagccagtagcgcgacacgttgaccaggtactgcggatggaagtagtagacagcttgcggcgattcgaagtcgtccagcacgtacttgacgcggatggacacgtcggtgttgcgcgtgttgtagaaggcaggcagcagcaccgacgcgttctcgtacacctgcagcacgcgatagaacggccgccgccacttctccagcttgtggaacctacacagggcgcgagtgagaggtgagcacccactcctccgtgccctcaggcccctcgcttccccacccttgcaccctggggctttgcaaaggacggaagggactcataaggccacctgcctcctgacacctcacgcacctgtgcagatgaaggtgagaactctctcaggggcagttgagttttttaagtgggtgcaggagagggcagttgggatccaaagggacagatatccagggtgtggctgcagggggcagggcaatgctgaatccaaaaggatgagggtggcccaagggaggctcagaagggaagtggctgcgggagtggaggcttgctctagaggcctcacgccattcacctgtactgtcatccccaagctccccagggacaaaccccaaatgcagctgcctgtcttggctcagacgcttcctctcctgcagcctccgtttctctctcacacactagtgtgttgttatttttagagacacggtcttgctctgtcatccaggctggagtgcagtggtgcaatcatagctctgtgcagccttgaaatcctgggctcaagcaatccccccaccttagccttctgagtagctgagactacaggtgtgcaccacaacacttgcctattttttttttttaattttttgtagagaccagggactagctatgttgcctaatttggtctcgaactcctggccgcaagccacactctggcctcagcctcccaaagtgctgtggttataggcatgagccaccacacctggccccatttctttacattaagcagcgttccctcttgggccctctctgactttgctgtctcttcccgccccttaaatagctgctccctgggcatctgatccaattcaatgaccccctcctctcatctcccactgtcccctcctcttacatgtcctctgacctggttggtgtggctacgcccggggctagggtttcaacacttcccctaaaaccttccagatgaaccccaggaggggagccaggaggggagctgagatctcagtgtgagcttctccccagtacctcctggacacagccaggtagggagctgcctgccctggtcacaccctggaaagctgacccacccatctctaggtgaaggtagtgtagaccagcaccgtccaaaagaactaatgcaggccacatatggaatttaacaatgtccgagtaagcacatatgaaaaaatggaaatgggtgaagtttttatattttctttaacccactatttcgaaaatactattacttcaacgtgtaattaatataacaagttaattagatatgttatcctgtttttgtattaagtctttgaaacccagtgtgtgttttacactcacagccagcacacctccagactaacaacacttccagtgcccagtagccgcatgtgactattggctaccattttggacagtgcagctctagaaagagggccactgacctctctgtgatgatgctggggttcacagtgaccacatccgtcttcacccccacatccatggtgtacttctctgagatggggggcaggttgcacctgcagaagagaaaaggcagcccaaggtggttggtcattcaataggtcaggctggggagggtgcagggggaggggagggatggtgatcatgtgggcagagggatgcaaaggcaaccagctaggcaggttctctgtagccaggtgataagacagtggtccttctgctccttatcaggcactaggacagccaacaggccttgctgaagttccagacacatggggcagagaaatcactggttgtaaaatgcagttacaagcttgggtagtccctggacctttggaggatgggattatggctcttagaggacaggtggctggggagcatctcctttcctagggagccaagacttccctgaggaagcaatgcttgagcagaggtctgaaggaggaattgagcaaatgtcctgtggcaggagaagagctacataaacatgcgatatgttcgaagatgcatcttagaaatgcaacacatattgcatgcaaaagcaagttgccaccatttgtagaaagccccatagtaggaagagtaatagcccccaaaggtgtccatgtcctaatccctggaacctgtgactatgcagccttacgtggcagaagggactctgcagctgcaatgaagtttaggatcttgagatggagccattgccctgagttatctgggggagtccagtgtcatcacaagggtctttataagagacgatgtgacaaccagggagagagaagaaagtatgtggcaacagaattggagtcagagaaagagactgaaagatactccactgtgggctttgccatgagccaaggaatgcaaggagcttctaggaaatgaaaaaggaaacaaattctccctgagagcctccagaaaggaatgcagttctgcagacatcttgattttagtccagtgagacttctgacctccaagactgtaagataataaaatctgtgttgtttaaaccactaatttggtggtatttttttatagcagcaataggaaacgaatacggccctaaacaagcatagtttaacaatacattgttcaggggtacatctacatatgacaaaacaatttttaacaatgagagaatgattaagtactcaattcaaggtagcgataccttcagggggaaacggaggtagaatgggaaggagcacaccagttgatacaaaggcaccatacaaacattcaacttcttaaatcaagtggttggtctacaaatattcattttattgttttgcttcatacttatgtggtacaaatattcttcacatcaaatactacataatgaatgaataataaattttgaaataagcaggtgttagctggttgaatgtggaactcatgagcattccagacacaggtcctgtgcaaaggtcctgtggtagatgagaacaggaagcacccaggagtgactgtggcccggtgactggagcacaggcaaggtgggagtggtacaagctgagggcagagagggaagaaggggccagactataagggacggtgggccatgtgaagaatgcggtctttcgtcaaggggaagccatgggtttaaggaataattgtgcagaagaaccctattctataacaggaccaggactgtcacctactttatgatccaaccatacccctctctatcagaccactatgaaaggcaggttttatattgtccttaaagattgagtgcgggagggggtggggtgtgtgcagtcaattaccatttttttgagcatctgtggcatgccaggaactttcataggattatatgagacatcaataaccttgggtggcagatattaggctcactgtgttgcaaatgagaaaccaggcattcagagggtcaagggacttgctgctattaggtggtcaaggcagggtggaggacgggcctgtctgactccaagcctaggtctcgttcctagtgcaatagcatctaggacatgcctagaacaggacggagtctcagggcatcttggcgtgcacatacaggcacccagcaaggctttgctgctgctgtactgctatgatgatgatgacgatgaggatggaagggcccacagcatctccaaaagtagcacaaacaactgtgtgctctcacagatcttaacagatcttaggtggtgggacaagagaccagcccctccgagggagacatttactatcatattatcgagctagagaaatgacatggtatcacagaaagaatgcaagaccagaagtgtatcccatttctgactatgaatagccccatgaccctagcaaggaatatcatcccctcccaaaaaattgttttttatctgtaaaatgagaggaatattttaaaataacattttccttataataaaacttagtatgtgtcctgcagtgtttgaagattttaaacatattaattcatttattcctcatactgaccccaaggggtagttactattatcatcctcatctttcattttaggagataaaggcagagtggctaggtaacttacgcaaagtaacacagctttttctaactcaaaccaggctccccagcttcagagcctgtggacagaaccactatacgctccacttcttagccctgaaaatcacacaagtccattctttcattcacgccttcattccttcatttaagactaatttttctgagtagttatgttgtgccaattacatcagttactgtaaacagaagttctctttgtgtttccagcctgcaagagcgagaccactcagcgggtccctggttatagggttaggttgttaaaggcctcatgataggtggacaccaggttccgtgggagcccagaaaagggtgcaagtgggtttagccagggaaggagtgggtgattcttgagctaagcttggaaggacaagcggcagttggcaacgcaggatgtaggggctggggagacagcattccaggcagagggaacaggacctggaagcgcagttgccggcactaactgggctctaatggtgtgtccagtgctggaggtactaagagctatacaatcattatgtgatttaatcctataactgatggagctgctatccttatccccattttgcagatgaggaaaccaaggcccagaagggggacatgacattcctgaggtcatgtgcctagcaatgctggagcctggatcaaagttcagggagaccccagagacctgggcttctccccaaaagaccatcttgaaagaggctttccttgcctttcctggcaggaatgtggctgggctaaggagtcagtgagggccagagatttcggtgttggaggaagcttaaccttcaattctggactcgactaggcgtccacagggagcacatgggcagactccagatcacagagagaggtgtgtctctcacactccgcctgtgacagcaggtgacgcagggtgtccaaggcttccttcttctagagacaggggctggggttggacagccaagaacccgaaatatgcaggagtccctttatttaaggacctcaaatcacaccaaacctgctctaccctccctaacctgacaccaactgagtggcccgatgattgtggatccatgcttcatgcgaccccactgcagactcaacccaagtctctttgctttaagcttttattttcaacccaccttcttcaccccagctaaagatataaatgaagatccacaaagagataagaggggggctttacggaaggaagaagtgcaaggaccagtctctggcttagttaaagccagggtgaagccaatattggtgtctgccacaaggcttccctggttccaaccactgcttctggaagggcagcacccacccaaggagacggtgcccagaggacctcccgacacagctgcaagctcctaagtcctcagtgccttcaaatctgtgatgtcctttgctcttaacacatctcccattgtgcagatgtggaaactgaggacctaggagttcaacgacttccccaaagggatggggctggagagaagaagggatatcccagacctgagggtctgcaggggtgggaagtggggattacttgcttaaagggtagcattagggaaccgggggaagaatatggaggagagggccatggggtagtggcaagggcagtgccagggtttcttttaccggaagacgaagtcggcgctgttgatctccctcccgcagcggctgttcttcaagatgcctccgttgcccactacagcacacttcttaaactgggaccggtagtagggcatgtcctgggggaggcacaggcacagctgtcagagccaagccaccccctgcctcgacctgctactctcacctctgcaagcacacccacctatattagctcctggtcccaagaggcagccttgtggggaatgtgggaggaaagcggctttccactttacagatgggaagagtggttgagagtcttgttactattagatggcaccaaaggccactcccatccctgaagcccagggcctgctgggcagctttcctcctggcacacagcggctggcagacctgcatgaaatgggccaggcctgcagcctgggcttccggtgggaccagcagcctggtggggtctcatggagagccatgctgccctggggccatcaggaatcaggctaaatttaagggggacttctgcgggagactgtccttatttgtggtccattttccctggatggacaggcccagtgagccaaggcggggaaaacaggggcctctcacagccagtaggtgagtaaactgcactattagacttgtaccagagaaaggcaaaaaaaaaaaaaaaaatagtcattttcagaaaaatcatcaaaagtttattatgttccatatggctgtttcctaaacttctgtaagttaagaattacctgggatactttctgaaaatataaatttctgggctccatcccagcaccacagaatcagagtctcacagataggaggctgggaagctgaattttttacaaagagatacttacatttagggaagttcaggaaatgtgattctatgtcacattgctttaattcagggacaagcgaactacatacagcccgtgggccacatctggcctaccgtctgtttttgtgtaacttgcaagccaggaatggattttatatttttaaatggttggaaacaacccaaagaagaaactattttgtgatacatgaaaactatgtaaaattccaattttggcatctaataagattgaaagtgttactggaacatagccactctcattggtttactcatgtctgtagctgcttttgtgctagaatgatagaggtgagtagtagtgacagagagactatgaactgcaaatcctaaaacagttaccgcctggcactttctggagaatgtctggtgagccctgctgtctgtctctggccttcagcggtccataggctgcttctccttggatctgtatgtcatactaagttgtgttacacccactggcattacctgcgtgagatgcaaatccacctgctgtcaccagcctcatgttccaggccttgtaagacccacctcataaaggtggctcagcaccatcctcccttagggccacagtgattgagaacacatttgacgccgctcacctgcagctcctcccccacatccccagaatgcatgagtcttacctatacactttggtaccagtcacagaatgcagggaactctgggctttgtttcgcactcagccaagaagcaaggcagccaaggccttcagatttcttccaaaaagacctctacatgcccccactcagaatttctataaactacattcactgaatgctgtcctgggcccagagctctcctgaatgtggttatgaacacacccatgcaaccttcctcctcttcagagtccatacgccaccacacctgggtaattgccagaactggctgaaagcgcaggttccagcgccccttctctgagagtagtgcggtgagtctgcaccaaccgtcagcccaggtgattgcaggtgctcagcatcagtgatctgaacagttcacgtctgcagctcactcactgcggtcctcaatggccaaggtcagtgatctgaaccattcaggtctgcggctcattcattttgtggtcctccatgaccagggagccaccgtgccagccctgcacagcctacctccagaattcttttatgtgaaaggaaaaaaataaatatctatcttgattaagactctgatattttagaagttctgttataatcagccaaatctattcatagtccaagccccagtgttacaaataaggagattgaggctttgaaagacaaaatatctgcccacggtcatcaagtgagctgaatctttcagagtctagatctgcactgggttgttctttcttgtgctcacaacttctgcatgtgcgtttgctcttgtgcctacctcaggagggggacgaatgtgttgtcattctctccctatctgcaggatatcctctgcaagcaatgcaatacccagaattttctagtcactttctcgccaaaagtcactcaaatcatagacagttggcagtcatggttctcagacagaacccccaaagaaatccagagggtgggcttctgcacctcagacaactggtcaaccaggaccaagacaactgagtccagaggaccgtgagtgagtcaggcaaaaccccagggacattgccacggagggctactgctggattggctccctcgccccacccagaccgcccccgcccaaagcagcaccttgggaaacatgcggaagatctcctggttgatgtggtagatgccactggtgtccacctcatacttgagctttgtccccaggggagtgttcttctgggtggtgaagagaaaggcaggggcgttgcagcacctggacagagtagacctgccaggcagggagacaggcaggaaagacgtgatgcaggaaagatgtgatggagggcagagcacaacctcacggagaacagaggggtggagccgaggcctctcctgctcacctatcccacgcttgcccccaccctgcatggagccgaggcctctcctgcccacccatcccacacacatccccaccctgcatggagccgaggcctctcctgcccactcattcccaggcttgcccccaacctacacctctgctcatgcagtcccctcccttttcaacgcctctcccaaggcccctgccttctgccactcattcagggcccaggccaggcttctttccatgaagccccacccagctgcccctgtctgcactgtatggaactcctcgacggagcctgagtcctggccactaatagagggtaaggaggagctttccaaagagctcccagccaggcctggcatggaaacttgggctgccgtcctggtgtcaagaggcctggattcttgcttctgctctgccccgaccagttgtgaggctactggaaggtctctctctttctctctgggccctagtttcctcatacaggcttggctcttctacctctaatcctctgtaatttgtgattccagcttgcaaaagccaggaatgttttatgatttttttttttttttttttgagacagggtctcactctgtcacccaggttggagttcaatggtgcgatctcggctcactgcaatcttcgcctcctgggttcaagtgattcttctgccacagcctcccaagtagctgggattacaggcaagcaccaccatgcctggctaattttttttttttttttttttagtagagtcaaggtttctccatgttggccaggctggtctcgaactcctaacctcaggtgatccacctgcttcagcctctcagactcccaaagtgctgggattacaggtgtgagtcaccatgcctggcctataatgtttttttttttaatttcatctcttgcaggtacttcactgggaagcctagctggctcccagtcacagagagcagaatttcctgtggagagctgggtttcagaatgtaacagaagcttcccagagaggagaccagaggcctggcaaggcagggccatggattggcattacaaactggcatctgggccttttagctttgctagttcagaagctcagtcttgtcagcccactggagatcactcctattgagggatactgactcacactaaccaagctcataagtgactgatatacaaaccagaatgtcagtgtgcctatttgtaggcagcagggtgggagaaggcctgttacaggattcatttcctgtaattcgaaagctcatgcctgccttctagcacccacctgacactccctcatggcaccaggttcctgccagcctgaatgaagcatctcatcattgttccatgagcttgaaatgagagcaaagggaggcaatgaccagcctggaaggttttctcacttagagcatggcaaggcctgatgtcactgccttttctcacacctgaaactgctccacacccctcatgcccagagctccacccctgcactgtgctgtcttgtccctgccaaaggctcccacactcatccctgtttttctcttgccacatcatttccctattgcttcatgtttcctgagatatgtgagtcctgctgctgagacttttttttttttttttttgagatggagtctcgctctgtcgcccaggctggagtgcattggcatgatctccactcactgcaacctccacctcccgggttcaagcaattctcctgcctcagcctcccaagtagctaggattacaggtgtgcaccaccacacctggctaatttctttgcatttttagtagagacagggtttcaccatgttggccaggctgatcttgaactcctgacctcaggtgattcacccgccttggcctcccaaagtgctgggattatagacgtgagccaccatgcctggtccactgctgagacttctattctgccctaagtctggacaacaggcttttgcctctcactgacctggtccaggctgagtgttttatcagccatactctcagtgtgtcaggtctcactcgcccccaggggcacctctgtgcagtgtgcacagtaacatttctaaggggccaattggcagcacagattatggttctattctctactctcccagcactttgctcaagctcatgttctgtttcttatgataggtgagtctctgcaaactactgtcaggcctttgcttggtttctgtagtctcccagaggcctctggcacctgatcttcaagtgttatcactttaaacattcgcatttctaaaaatgtgcctcttaaaactactactctacctctagacttggtctggagctgcagcaaattggaacaaatgatttataaagaaaaagcttagtcatctttgcttttcacaatcttgtgcaggactccttcatgcttagagctcctcagtacatttaaacttggacctgagtgctgaaatccagtatagacacaaattgccagattacatcaactccataaaataaggtctacctgcactaaaataatcccataagcttacagaactttagagatggagaagaccctaaagttcaccatccatcaaaaagaatttttggacatctgttatttgcagagttcccacaggacaactttaagatccagctcttacctctctggaagtttataatctgctcattttggttagagagcatttataaaataatctgcagcagggctcaaatgtctcgtggaggctggaagaactcaaatgctctgagaaggagagaagctactgggtcagagccgctgccccaggacaggggaggtgaggaccaggaggctatagaggatgcgtaatgcaccttcacacaggcctgctggagaccgcccacacatgcttccctgctaatagcttcagtgaacctcagctgtgtactggagatggcaccaccaacctcacaaggctgctgcaaggactaagggagagaaggtggaggatagcacctgggcaaggtgcctgcctcagcctgcatgttgaatcagatctcccccactgcccggattcctaagcccagtcagggtctgctctggggaagatgcacgctgagagctgggccttgcaggacaatggagaccagaagaggtggcagtgaggagaatcatacaaggagaagggaggacagacgaatcatagatacttgaactggttggcctcagagatgttcatcgcccatttgcacatctggaggctcttccacctgtcgaacagctctgactgcttcacccttgggagtagaggacagaagagtacatgagcagggtaggcgggacagagcgcgatcattcccagaaatgctccctcctgatctcccataggccaagtccagtcctggggctggcccttggcattgaccatgttttcttctctttctttgtttcttttttttttttaagacagggcctcacaccgatgtacaggctggagtgcaatggtgtgatctcagctcactgcaacctccgcctctggggttcaagtgattctcgtgcctcagcctaccgagtagctgggcctacaggtgcaccaccatgcctagctaatttttgtactttttggtagcgatggggtttcactatgttggccaggctggtttcgagctcctgacctcaagggatccttccgcttcggtctcccaaagtgctgggattacaggtgtgagccaccgtgcccacctggtattttcttattttctatattcctgatgctctggcacctggtgccttgctaattcctagttagcaaacaactgtcctgcaagtgtgcctttcatgtgcaaaccaaccaatcagagcccacaccctcaaccacctcctcactgacaggccaccatcccctccccaccccccaccctaatcatcccagggccaggtatcggacaaacagaggcagtccctatgcctcagagcctgccagaattattcaaactagccaatcctaaacctggctaccctgccgaccctgccttatccattccctcccctgaaaacctcaatagtctcacccacactttcccctcactgctgcctcctgaccggccctggggctgccctgcagggcatgcctcctgtttctagggatctgtgagtataacgtcttacttcatgatggtcattttcatgtctgcgtgtcctactgtacctgattaaaacaaatcccagaaacactttgaaaccttctccctcacgtgcccaccccccagggcctgcatagttctcttgggaacatctgtctataaagagagtcagaccccagtggaacacccatcaaacacccacacagttcagcacacagtagggctcatgagcagggcatgcccttctctttctcccttctcaagggtggatcacagtttccaaatgacagaaaggatgagatgagaaacctgagactgccccttctccctgaaaaaccctcggccagcctctatgctagttggcatttaaacatctcagcatcatgacattctaaagcactctcaggaaagggaacgtctaaaccacacagcattctccctttgaccgaaacctgcaaaaagaactcatttttaatttacacatttacatcgacttatttataattatgcatacatataatcatttcagtgctgtatccccagcttctagaacagtgcttagcaaaatatagatacttgataaatatttattgagtgaatgactgagccaaatcaaaaatacaaattcccacaaacactaactgaccaatatgagatcctcatgtacattaacctcaaatagtcgctcacccttcttatcagtttctcccctctttcagcagtgcctaagctcagagccaagtccacattcccaagctctctctgtcacagatccgctttagcatctccattacctatccctatctttagttactccttccgcatttcagttaagaaattgttccttgcatcctaaccaattccttcctgctttcacttacacttggttttgcgggtgattctcctattctacagaaatgtccagaattctctaggatcccagctgttgaaggttccactgaggccctggcctggtgagagtcatgagatccagaaagatccaggaagctcctcaagccaggccagcacccactccttcttaaggaagggagcacaagacacattatacaattgggcgagcccttcctgatgaactccagatctttggcaaagaattatgcatctttttttttgtttgttttttaaggtggatcctatggtcaaatatagttggggaaagctgagctaaataaagttaaatgcttttctttactgcaagacttctcagatcccttaatatgtctcatatattgtgaatttccaagaaaattattggatcgtctttttccattgagtagttcgaaaaattgtaattctacagtaaaactgcgaaatgcagacagatcatacactccttaaaggcagcaccatgatttctctctcttgatcatgcacagtccccactttagggccaggcattctgtagctgtttggggtcacctggctgtggcccactaagaagctcattagtcttgggtgctggtgcagacaggagcccttgaaaggaagctgtcctgtttgatcataaatgggaaagtgaccagccttcaggagctgagtgttaccaagaaactactatcactgtggctcttaccctggggtccactgaagggctaaaggaagtgcctgtaccccccgattttgttataggcaaaatccatgtctatccacccacgtgcatatctttggggagaatctgaagctttcttcaggttcctacaggggtccattatttaaaaaaaaaaagcaaatacccactttaaaaaccctttttaggccgggcgcagtggctcacgtctctaatcccagcactttgggaggccgaggcgggcggatcatctgaggtcaggagtttgagaccagcctggccaacatagtgaaaccctgtctccactaaaaatacaaaaattagccgggcatggcagtgcgtgcctgtaatcccagctagttgggaggctgaggcaggagaatcgcttgaacccaggaggtggaggttgcaatgagccgagattgtgccattgcactccagcctaggcgacagagcaagaatccatctcaaaagaaaaaaaaaaaaaaccctttttaaaaaaagggttcattttgtagaggcatgtcctgtgtttaattggaggtggtaacagttgtcctcaaacaaggcaagcctcccctataggaagaatacatagctggcaggggaggggtgattgcaggaaaagtcatggaagatagtaactaaatacatggattttggaactagtgggacttgggctaagacctaagtcttagttcagatagctgccaactatgagacctcaggctggttatttaacctctctgagtctcagttttctcatctataaaatggatgtaataatagtctcttgccctcccaaatttgttgaaataattaaataggatgatgtgataaaagactaggcatggcacctgacacacagaaagcatccagtacatataagttattagtattgttacactgaactgccctgactatgctcactcacagccccctgtactttccacttttgtaaaacctatgacctatcatgattcctgatctttcccactagacagtaaataccatgggggcaggggatcaagcctacgctcatcactgtaactcaagtgctaaggcacatagcagatgcgtggtaaatatttgttgagtataccaataagttaatgaattaattgaaacacctgagttcaaatcaagtctcactatttgttgagttatctccatatggcaggaactagaaatacagtagtgaacaaaacaaccccttgcttccatggagcttacacaccaattggggaggaaaatggaaaacaaatatataatgccttgccaggaagtggcaagtgccaggaaggaaagtgaagcaggttaaagggacggggaagtgactgtttcagactgagtgatcagggaaggctttcctgaggaggagaaccttgcacagagacctgaaatgacacaggagtgagctgtgcaaatatctgggaaaagtgtattccgggctgagagaaaagtgagtgcaaaagccccagcctggcagctttcctcctcccaccctggctgacagaaggcaaaccttccttccagctttcccaaacctcccctctcaggacctcacagggtatgagggagaggtgccatcatacagcaacaccctggctcacccactgccccctgccccttcccactctctgcaatccacaggcccctagagcagccccctatatggccactgcttcaaatgccttctggaaacacagccctggcaaaactctaggcggggttccaagctctactgttaccagcgtctgggccctactctctctgcctccaatgccctcatcacaccctggaccaaggtcagggcctgggacacccagccttgaatcctggcaccatcccaatcttgcaatgtaaccttgggcaagtcatttaatctctctgagactcagctgctttatctgtaagttggatataacggctggctgctgcccttccagtcttaaaggttgtcagagagctcaaatggaatatgtgtaaaaagattttacaaattgctttacaaatgcagagatctttaaagatgaagggttgaccccaggcacttttctcctttctcccaagacaccactaacattccagaagaggaattaaaaaaggtacaagcccatagatgaatagaatgacagggaagggcatctcagtagaagagaaatttcaacaagtgtatggaagtacaagagagtagcacaaggacaggatgacacagcccaagtacctagagccaatctgcacatggaaaattctaagaggtgggtggaggatggggagggagcatggccctaaaaatgagaatcagttgtgagtctgtaagcagaaccatcaagcctacactccccctaccccaccaaaaaccatggcagccaaatgcttaatgtccagcagaggaggaggagagatggaatcagactattagttcctctgttaaaaaaaaaaaaaaaaaaaggtatcatttacagttaaaagatctggccgttctagcaacaaaagggccaggagcatcatgaacaacttcagacacagagctcctatcagtttttatttcaaggttaaatatggatagatagccaagggtcacctggtcaacctgaagtgagaccaagataacccatcagataaaatgaccacaaagacaactattggaggaacaaaacagaacttaaaaatattctacttagggtacaaagaaagaactcttgtgggggaggggttcaccagaagagctggaagatgaagtcaagggattttcccagtatgtggaagcaaaaagaggagagaaaaaagataaaattaaaagatatgaccagcctgagcaatgtaacaagatcccatctctacaaaaaaatgtttgaaaaacatcagccaggtgtggctgcatgcgcctatagtcccagctactcaggaggctgaggcggcaggattgcttgaggccaggagttcaaggctgcagtaagctatgatcacaccactgcactccagcctggttgacagagcaagaccttgtctcaacaacaataaaaagatatgagtactagaggtacaatccagaagtataggattattagattaaagagaagaagtagagagaaatggagaagaaggaatataaaaagatttgagagaaagttgaagagtctggacacaaactccaaataaaaagattccacatttcagaactgtaaagattccagaggaaaaaaaaatggatacttccaaagaaataaaacaaccattctcatgcttctcatgtatccctagatgctaaaagatggtagagaaggtcttcaacatcctaagggaaaatgattttcacctaaaataccaacccaccagactagcaatcaaaccaacaaccccacaacccaccacaccaacaatcaaaccaacaacccaacaatccaccacaccaacaatcaaaacaacccaacacaccagcaatcaaaccaacccaacaatccaccacaccaacaatcacaacaataatccaataactcatcacaccaacaatcaaaacaacaacccaacaacccaccacaccaacaatcaaaacaacaacccaacaatccacaacaccaatcaaaccaacaacccaacaacccaccacaccaacaatcaaaacaatccaacaacccaacacaccaacaatcaaatcaacccaacaatccacaacaccaatcaaaccaacaacccaacaacccactacaacaacaatcaaaacaatcccacaactcaccacaccaacaattaaaccaacgatccaacaacccaccacaccaacaatccaaacagcaacccaacaacccaacacaccaacaatcaaaccaaccacccaccacgccaacagtccaaacaacaatccaacaacccgtcacaccaacaatcaggtaaaagggaagaatccagtcatttagacacaaaaggactcaaaaccttacctcccacctgtcacttcttggtatttacttgagaatgggtggaagtaaaaggaagaagtaaacacaaaagaagctataggttctaagcaaaggtgaatccaacctcagaaggcagagaaaagaagccccaaaacaacagccacatgacccagcaagagggcagccagactggagcaagatgatgaagagaaaccctaaagggaatgcctgaccgatggagaggcagggaaatagatacagctataatagaggaaacaaggggaaaaagatggctagaagctccagaaaaagaaagaaacatgtacaagaaagttgatggagtcctggtgcctccctggccttcagtgaacaatatctacatcatcccaataatggaaaacactatttgttattcttcaaattttagagttaatctctagaaaaagcttcaaaaagggcttggtatggttacaaatagaatacaaatgttatcggccttgtcattttaaaagtcaacgcatggatgacagaagcgataggctggagggggaactgcagagtaggaataattttaatatccttatcttatacagtgcaggattaagagatactgttgatatttggtagaacaagaaatcgattacttaggtaatctatagacagactaaaaatattaatacccctcaattgtggaaatgtgggagggagctgggcactaattgtaatgaaatgagagtgattctctctttactcttctttctccctctttttttttctttttttttgagacggagtcttactccgtcgcccaggctggagtgcagtggtgtgatctcggctcactgcaagctccgcctgctgggttcacgccattctcctgtctcagcctcccgagtagctgggaatacaggcgcctgctactacgcctggctaattttttgtatattcagtagagacggggtttcacagtgttagccagaatggtctcgatctcctgacctcgtgatccacccgcctcggcctcccaaagtgctgtgattacaggcatgagccaccgcgcccagcctttctccctcttttctttcacagcctcctgtttgcacccgggtctcacccactccctctgtccacttattcatttaacacatgagtactgagctggcatagggccagactcagagatgccgaagcctgggtcctggccctccaggaacctccacctggcagaggacagagacttgtgaacactgcaatggcacaaaaggggctcccagtccagagagtgggcatttgcccagctggcctttgctcccagcctctttcttggtctcagtactgggctcagcacagagctcccagtggcagaaaaatggggaagggtgacaggagacgctggcctggggaattctccagcatgacccccatctgggtgtgagcacaggcagcaactgaagattcttattttaaaataaaggggctctagatgacaggtgtaaataattttagtaagaattagtgacaatgagttttcataacaaatcatcatggagtcgttcttcatgtatctgacactgtcagggagggaggcattttccatgtggggattttctggctgactgacttttaccactgatttcagcaattgtggatcagaattgttcccagatgaaccatacacctccctgtctcctcaaacaaaacaccagctgacattctgcaggcccgaaggggcaaagcacatccatcagcccctccattcacagatggactttaaccttttcccaaagactgagggttggaccctctatgagtcctcctcatggcactgggctggagcacagtgaagcccccgggtcccaagatagtgtcagaaccactcagatcagaggccggcctctgcagctctctgatttcagccctggaggacctgctgaccctcagcttggggactcaggaaaggaggcacacacactcatgccccaggaacagcccagcctctcgttccctctcagactcccagggcttggggtcacagagaggtaactactgtagaagagggagggcatgcaaagcccagctcagccaggggccccagctaggatggctgctcaccctaggagcccagcccctggggacagagagggtgccccaaggcagagatgagaaccaaagccaaatgtggagaggcccaaacaccaccaatgggagtccataacagggacaagtgatggcaagtggaatcgatggaaggtgactgtctctcatgttcctctctaaagagagtgcagagaccatgggctagtacagtcagaccatggggacatatgaggttgtccatgacactgaacagtgtttgtgttttgagctcaaaacaatggccctgggttatttctaatctggccctaaatggaagctgtgacaggggctgttgtgggctgaagtgtgtctccctaaaattcgtatgcttaggtcctaacccccaggaccatataatgaaaccgtatttggagatagggcctttttttttttttttttttttttttttttaggtggtgtcttgctctgtcagttatgctggagtgcaatggcacaatctgggctcactgcaacctccacctcccgggttcaagcaattctcctgcctcagcctcccgagtagctgggattacaggtgcgtgccaccatgcctagctaatttttgtatttttagtagagacagggtttcaccatgttggccaggctggtctcaaactcctgacctcaggtgatccacctgcctcagcctcccaaagtgctgggattacaggcatgagctaccgcagggatagggcctttaaagaggtaataaagttaaaatgaggccatcagagtgagccctgatccaatatgactgatgcccttacaaagagagattagagcacaggcaagactcagacccggggcaaccatatagggacacagcaagaagaaggccattggcaggccaaggagagaggcctcagaagaagccagctctgcagtatcttcatctcagacccctggcctccagaattgtggaagaattaagtcttgtgtaccttgttacagcaaactgatacaggacctaacagcaacatacagaaaatacatgcatagagggatgggaagttccccagaaggatgaccccattcataggatttcttaaatcttcctgtccagaccttcaaggaaccatgaagaaactatacattttataatttaaaaaaattagtcagctgggtgcggtggctcacgcctgtaatcccagcactttgggaggccaaggcgggtggatcatgaggtcaggagttcaagaccagcctgatcaagatgatgaaacccccgtatctactaaaaatataaaaactagcctggcacagtggcaggcacctgtaatcccagctacttgggaggttgaggcaggagaattgcttgaacccgggcgacagaggttgcagtgaggcgagatggcaccactgcactccagcctgggtgacaaagtgagactccatctcaaaaaaaaaaaaaaaacagaaattagtcatttattctctgaaatcttgaaggtgtgctttcaatcacagtgctctggatttgcacagtaaaacatggaagggcctgaaagctttgaattctgagaagacagactctctgctaccagcttctgaacttggctccaacagccatttttgccactaaatcaaaactccttggaggcatgtttaaaataccaaccagctcacatgccccaggccctgcttaaaaccattcccgtggctctcatggcccttggataaaggtaaaacccaaacctgggtctgtatcatgaagccccacatggtctggccctacctgaccctctagcaatgcagcttccgtgtcttccccgccggcattcgagctgccccatccttcagagcccgggacacagccagctccctcctggcatagggcctttgtacagactgttccctccacctggagtcctcctggcctagttaactcctgtcacacttcagactggagctccagtgtcccttcctcagagaagcgttgcctgacatcctccccctagtcccagcctgggtcaagttccctgtcactaccccagctccttagggtaactagctattaatgtctgtccccctcagtggctgtgagttccacaagggtgggcaccacagtggtatgtgttcagctcagggctcagtgaaactgataggtggtgtctgtatcccaccttctctggagagggtacagagaccatgggttagtacaggggccataaacaatgcagctaatcccagctggatgctggtctcacccttggagctttccaggaaccgctgagctatggagtctgtgcatgacagtccagaaaagctgctgctactagttccaaaaaggaaaggaaggaaggaaagagagagacgggtgctgacatttattgaacacctatgatgtgcgctactgagcatgaaggctgctgggctatctactttctttttttattttattttattttattttttgagacggagtctcgctctgtcacccaggctggagtgcagtgacgtgatctcggctcactgcaagctccacctcctgggttcacgccattctcctgcctcagcctccagagtagctgggactacaggcgcctgccaccacgcctggctaattttttgtgttttttttagtagagatggggtttcactgtgttagccaggatggtctcgatctcctgaccttgtgatcctgggctatctattttcacatgccttatttcggctagtctacagcaacccttaaagggtaggtaatagtgtccccattttcaaaggtaaggaaaggctcagagaagttaagacatttgcagaaagattcacatatgccaaggcccagagtcagctttagatctcaggtctgcccaccccaaaacccatgctcttcccctgatgcacactagttggaatcacatcagatgggtaaaggaacaacggtccctgcctgagggccagggaccccagatgcccctggggttatgtcaggggaccgatgagtccatctgagcacccaacattgcctgcctctgaataaactatattttttccacatccagatgtaactgtttgcaaataaatacagattctgtcatgactaatatagtaccaattcttctaaatgggtttgctgaattcatggcagttctgtgaagggcggaaacccaggtgggcacatgcatgctaaaatgttcagcatttaatgtgctttccctcctgtgggttgaaaagagctataggtgatgcattgttaagtggggagtggggagcacagctcttttaccatttatgtaaaaaaaaactttttaaatctccatacatagattcttattcatgcattgactctgcaaggatacccaaagccacatcgtcacctctggggagaactcggtggctcttcattgaataaccatctgtactgcacaaattttgtatcacctaaataatttaaaaatccaaacttttaataaaattaaaaccatcaaaggtgatagcaagagggcaacgcttaaccctgcggtgcaacatactgaatttcaggcaaaacagtcctgtgccctcttcaatttctacacaagaggagccagtaatgataatcagagaccagtaattgaggcggggactttaacaccgagtcaccagaggtgaccttgcaaacttggccttttgtcataaaacaggcacaatcatcactgtgttccagccctccagggctttccgaatgccagtggctctggggaaggagacctacttttcgctctataggaacctaccatgtgtttcctgtttccttccacccttgcccccacgcactcacccccaacccctgccccacctccacatgctccctgcacccaccacaaatggccacactcacatggacagcaccttcacttccaatatttcgtgcctcagctccaggcatcttgtggagttatattcaaaaggcccctcataaaattcaaagtacctggggaccaacagagacaggttaaacagagaagcaggtcaggatgtccagggcctgcaggggctcttgttgcagggtggagtgtctgtcccagtgaaataaataaagccaaccagccccatcccagcagatgtcccattaggggcttcaggcagaccatggggccctctggcttgatcactgggtggtcagttactctcagcgccccactcccttgggagtgtaggcatttacagaggcataaacagatttcagcacacagggaaattcagaagcaggtttggttccaagtttgtggctgggaaggagaggggaggaggagggatgctgtgtgtactgtgatcagagaaagcagagagaccagagccattctggcgcagcactgggagtccgacagtgagccttcaggcctccaacttgcccttccattccctgcccctttcccacttgatcctcgtgcctacactgtgacatagctgagactgatgggcctttctccccatttggcagctgacaatactgaggctaatcagacagggctccaggtcatactgtccgtgtagggcaggaccagggcttggtctaggtctacttgcagaacagaacaagccccttccagcaccagctggctccaggcatgtcacagccacctcagggtccctctgccagcttcatgcagaatatcaatgccaatttcaaccaacacttactaagcccttaccataggctaagcaccaggccaagcatttgatgtgaatggatgcattcacttttaatctttctaatcagcctatgaggaaattgacacaagcatcctgaacaggctctaggaattaactaaggtgcccagacccccggagctggaaggtggcagagccaagatgggaacctgcatgctgactcaaggctgctctttctgccacttggctatgagcacggctggtgtcccctggaaagggccctctggcctcctgtggcagaggcccggtgagccctctcctcacagcccccctcctcctggcggttgttcagaggcaggggtgggtggagcttggagggttggatcccaggacagccttaacatcatgaatccagaagcctgcagggccaaaccactataaacatgggatcagtggcctggcaacacgtagtctgcaagaatcagaggtgagaggggctccccagggccaaggattggaaattaggcatcgctcaagcatctcccagaaaccactacacacagcagtggtcatttcgcacgtacccttacacactggacaaacttatgtatgtgctgctttagaaatcttgaaatattttacccaatatattggcttcttttaaaaatattggtatttttattattattatcattgtatttgtattgtcattttgtcattaaaataatactgtgatactttaaaagttatgtttataaatatttgtccttaataattttaatatagttttaagtactataattacatatttaaataattttacataatattttaagatattaaaatattttccacaacaaattggtccctatttacaaaataaattggctccttgttctcatgtcataaaagaatttagaccaagttaataagaactaggtattgaagattcccaaaatatcaaacacctttgtgtcttacagctccttttctttctcatctggcaaactcaaatggattcttcagtacccggctcgagtaaccacactgctgggaagcctcctctgaccctgaccctgggctacccctgctcactgtctcttagagcaaataacatggtattgggttggtacaaaagcaattgcagtttttgcctttttttttaagtaatggcaaaaaccacgattacttttgcacctacataatagtacaattgtgtgtttatgtaattgtgttcctttccaaaccacgagcatctcaaacacagagacagtgtctttgttatctctatatcttctgtactacagagggaggaaagctaaaaatgacatttcccagactcctttgcaggtagggttctggatgcaatttaggttcagccagttagaagcatttgcatgagatggattcagacctgttataggggaagaatggcaaggctcaaggcatggttttgctggtgcagaatgtggcagaggtggcatggctcttggaaactgcagtagtggtaacaccttcatgattatatcagaggcagcagctttcacggtggccccatttcactgcaatttggggaggaattcttggaagttcagccatttcttcagctttccccatgaatctgagctagctgtgcccttaataaatccttttctgctttaactagctaatgtagattctgttatctgcaaataagaacaaggggtcagcctagggccacaaaacgagcccatgaccttggctctaactcacctaattttccagtcacacaacagtgagctctggtgtcctatcacaaagatcactgtttgtaacatgagctggtgtcaactaagccctttggaatccactgagtcaggtaaagtcatggtcctaggttgctgctaagaaaaggtccagattcaaatgatgcaggaaatcattaggtcgagacttatcctagagttattggggaattggggacttgcagacacatctcggatatggctacaaaccagctgtgtgactttgggtaaaacttcccctctctgcatctcttttttctcctctttaaaacaatctgtttgaactagggtagtacctcctcttcaatcagccagcccttccatttcctccacaaaggcattcctgccttgcctcttccttggttcctctttctcctgcatcctcaacatcactcatatacccaactaggcagcatcatgattccaaatgaccttgtgccgtggttttggtggtgcttaggtagagaggctttcagaactgggttcacatccctccacccctcattggcctctgtatggtctgaatgtttgtgtctcctctacaattcatatgttgagatcctaacaggcaaggtaatggtattaggaggtggggccactgggaggtactgcaggcagagcccccatgaatgggatcattgcccttacaaaagaggcccaagagagactcctcttcccttttactatgtaaggatacagcaaggagatgctgtttatgaaccaggaagtaggtcctcacctgaaacttaatctgccttgatcttggacttctcagcctccagaactgtgagcaatacatttctgttgtttataagctaagtcactcagtctatggtattctgacagccacattaggcctggcacttttctgctcctttgttttctcagctgcaaatcagcaaaaacaatgcagtgcatgtgcgacagggttgagaaaaaacactgctgagcatttcatggaatccactggcacacaggaactaccccaaaaatgctcattcccctctgtcctctttgtcccgccactaaagagcacgtgataccagtggatgccccaggaagtcccagggagtcagagacagtctctgatggtaagctggttgatggcaggcctgagtcagggatgaacaactcgaagtttctcactgtgtgcactggtgacatcctccttctgctgtgattagtaaacctctcccctgtcaccctgtggataaagcccacactaagtcctgcttggacatggacctgcttgatcacctcatctcactgaggctcattaaccatgtgcttctgatgctttgacacctggggccttgctgaccctggagggactgcctcttctagggctagccaattcctggagatagtaaaggactagcctgtgagtgcacctttcatttgcaaaccaatccagagcccatgcccctatcaggctcccatactcttggacactggaatagctcttccccactcaccccagggccaggtcctaggcaactagggataacccctatgccccagaacccactgaaattactcagatcaaccaatcctaaacctgcaaaccctgcctcaccagttcctttccatggaaatcccaacgacggctcttgcccacacttccccctcgctccctctgcctccttactgatctgggtgcttcttcccatggtcctgcagggcctcctgtttctagggatctgtgagtatcaaaacctcttccttcatgacagtcatttccatattttcgtgtcttaccatatccgattaaaacaaatcccaggcaccctgaaaacactccaggtagtaccttagccaagtcatcaaaactattccatgcctgagtctaaagcctcagttttcccatctggaaaatggagctaatagccctggcttccttctctatcctacctgggctctgcttttttggtccgtactgctctagctcagtctgtagagatgattgacttgaggttgctatggtctaaatgtctgtatccccaatacaaacattaagtttcatgtttaaacttaatccacaatgtgatggtattaagaggcagggcctttgggaggtaattaggttatgaggtctctgccctcaatgatgggattaggcccttataaaagaggcttcaaacagccttttgcctttccaccatgtgaggatgcagcaagaagctgccatctatgaggaacgggccctcgccagacaccaaatcttctgccaccttgatcttggacttcccagcccccagcactgtgagaaattaatttctcctgttataattataaacgacccagtctaagctattttgttatggcagcccaaaagaactaagataggaaataagattttgagaagcactgtcccatattctgcttctaacaggacgctcaagaactgcattttggagggtgtcatggaaattcatggaaattcccatttggtctggatacagatatacagacatcaaaaatgttgcttaaagtttttttgtctaatgacataagaagatgctcacatgacaatgttgagtaaaaaaatgcaagttacaaaactatgatctccaaaaagaattatatatacgtatgtgaaagcatgggcaaagggaagaattgtaacacaatattaataggggtttctcagaataaatgggatgatgcgttatttttttaaatacttttctgtgtttttataagttttctgcaatggggttatgattcttttattattggaaatcactaataaattcttttttaagtcccagaccttcttctaactatctcaagcttccccttaccctgttacaagattgagggaagcactttctccaaccttcttaaactccactagcctctcaaggtgagttcgtcactgtctctactttcaatgctagaaagactatctttacccacatcaaaggggagggcaccctggcaccatgtagggcatctcacaggtataaatagtcccagcgggtgatatcaggagcccaactcctctcaaatgccactcagtttccagcagccaaatatgatgctggtgccaggctgcatcattctgccccatctctctgccctccactaagtgagaagacaaatgcagaaggccagaaagaggtgaacacagtggccctgggcatcagttctctccctgcccagactgggctccagctctgtgggctaaggaggcctcctttctttttcttcctttccttctttccttctttcttttctttctttctttctttctttctttctttctttctttctttctttctttctttttctttctctctctttctttttctttttctttctctctttccttccttccttctcccttccccttccccttccccttcccttcccttcccttctccttccttcctttcttcctttctttctttctctcttttttttttttttgatggagtctcgctctgtcacccaagctggagtgcagtggcatgatctcggctcactgcaaactccccctcccgggttcaagtgattctcccgaagaggctcctttcagcatgcccagggtctggccctctgagagcctgggtctgtaattcctatgagcctttccccaaaagcctgccccacagaggctcccctgttggcctgattccctctccagagcttctccagggccatgtttcctttcttgggggcaacagtactctgggtcccagcaaccactggctgctacaagatgaggtccatgcattcagctttctatctaacacttccccatccccacccccagacactgatggtactccagagaatagaagcccaggggggtccctgtgtcacgcacaaacacctgttaaatctccactagccctaggtgaacagggaaactaatctgaacacctagactcctgtccagcttggtgcagagtctcagagaaccatggagttgtttatttattccacactggttagagacaccactagcccatatagcgcctctgtgcaaataaggaaaaagcaccattttccccagataaattaagccacatgcaccagacacatggctggtcaagtgagagtaagctgtacttcagcctcacttgactgcctggctgagtatctttgtgcagtgcccaccctgcacaactgtccatgacagcctgataccagaccatttaacttggtctcatttaatcctcccaatagccctatgaggcaagcataatttcccccattttatatctgagacttgaactacaagaggtaaagtaacttgcccaaggtcattcagctagtaaatggtggcactggaaaagaaacctgaggactgtgagagcccggaacccctgctcttaacagtgtcactgcacttcctctccctgactctgacagccatcgttctctggggggttttctcagtcagcagcccttccccctcccaaaggcaacagcccttcagtgagctcagcgctatttctagagccagaacagctgccgtctcgagatagcacacgacccgtcacagcaaacgcacagaaatcagtctgaaaattgcagcctgacaattcaaaggactgaagtgtcttcccagataggtaggagagaggcaagaacagctcagctgttaacaactgcgggtcacagctgtcaggagacatgccatggcagtggagagccccggctccaacccctggctggtccatggcccggctcagcagccttgaacttcacctgccctctttgggccacagttcactcatctgtccccaggaattatcagagctgttttgagatatcagaactggatgctaaaaagcctgatgttctcagtgcaaccctaaatagtcctgggattaatctgccccaggtgtgcacctcacaccaagcctgagggtcatttctggcacagggtgggggttgggggtagcagggcaaagcctggtgtctagcttcattcctccttccccaccccggagttctgcagggccccagatccagtgtttaacatattccctgtgagagtatgtacatgatgaccttattttccaggccagactagggagccctgaaaggcttccctttgtaaaattcagctcaacagccaggaatgcctcagtgtgtgaatgctagcactggccagtgcccctactgcttctcatggactttgaccaccatgcccacaggcaccctagccaagagatacatcctagctgcctccttctccttccttcatcttccgccaactctcaccacttctccttcctgagtagtccccatctccaccccagtgccagggaaaggattcggtcttctcccccctgggggagtctctctgtctggaatactctttgctttcttgctagtccctgcctactcattcagcagagtcagcccaggggtcagcttccactggctcccttcgtggccctccctcctctgtgcctgcagcccctgggcactcctccagaccagctcttattatgtggaattacacacagctcctccatggcctgtctgcgctgttgatgcgtgagaagggtttttctcctctttgactcatcaaagatttatagaccctctactgtgtgccaggaactgtttcaggccaggatgcactgatgaactggccagtgtccccactctcatggcacttccacaggggcgacaataaatgattcattcaatataatgccacatagccataactcttccaaaaaaaaagcaggacaaggaattggagggtgcctggaaggatagtgggtggcctaggaaggccactctggacaggggacatgaatagaggcatggagccctgtgcagatgtgtgggaagaacttcccagagaaggaagtgagtaaatacaatcacttgctctgcagtagcagctgccaatgtggctaggcagggttgtggaggtcagagaggtgagcaaagccaagtcaagctgggcctgtgggccacccagtatcatggggactcggcagaggaacaacgtgatctgatgtggggataaaggactgtaaagggagggagggagaactattgcagcatgaaaagacagtcgattgcactaaggggtggcaaagaaagtggggagaaggagacagacccatgaaatagtttaggaatggaaccagcaggatgcattgataatttagaaagtgaataaatcaacagtaactcctaggacttcagcttgaacaactagcgggatgacataaccatttaaaggttagagagatgaacaggtttggggtgttgggccctgtgaagcttcctgtgccctcagacatctagaggagatcacaggtaggcagtcagatgcacatggctgaggcccagtggtcagggctggggatgcacattccagagtcaaaggacaagggacttcaggaaacactgggagagagtgcagagagaagaagaaagagggccaaggacaggcctgaggtcagctcccacattcagatggcagcaaatgacactgagaagaaaggtctgcaggtggaagaaaacccagacacagagcccagggacatggaagctaagaggagggagcatttccaggacagatgggccatatgcagtgctgacccatatgtcttggaaatgggggtcaaagaagaggaggacagagaaggcaccactgatctagcaaccaggaagtcatcaatgaccttgacaagagcagattcaagggagaagggaacagatgcccctctgccgtaggtggaagcaaggccaggagtgggaaatgttggagatggtgccatggaagtctgcaggtgaaggagggctgagtgagtgtccgaagacctggtcctggggcaagtggagaggatgggatgtctcccaaagtgtaaagggatggctggaggaagaaaagagagacttcagtgttctgtgagcctccaaaaggcaagcctaagagccccagctgagacttagggaggaaaggtttacaatcagccagaggaagcacttcgaaccaggaggctcgcatggggaaggatggcctctttgggagcttcatgacctgctatcacttactagcttagcaaggtcttggtggccatcaagttgggggatgccgggctataaatggagacatgcagtggaaaactggaagagcctccagctgccttaaccttgtgagcatcccctaatctaatgggtgggtggatgcttggtccttccagcccgactccaactcccttttctttccttctttcccattctcatgccttcccctagcctcctgcctttgccaagtgattggcataaaattctcaaagatggtctacaagggaggaagcacaggatcgtgaagaaggagaagagggagaatgggtagtggaagctgaagggaggaacggagtctggggagttgacctgcagtgaagaaggggtgaggccctgacaggcactgcacccagctgatccggcctcctcagtttacaggaaagcagacaaggcccagggagggagtgctatccccccacggaagtgctgtgcgtctggggcgaacctaggcccactcagagaaccccaggagtgactgagcagggggggaagagaccccctcactccacctccacggagccctatggggacctgtgaggtgctttaaccttggagcactcagggagttacagagcctgtgacctcctttgtatcacccccagagttgggttaatgacctcagttttgcagatgaagtaattgaggcacagaaaggtttgtgtaagtggttatttgcccaggagactccacagagactcaaaagccataaagctttgggttcagagcactcctggagcaaccctgacttaaggaggaggagtctcccagtgccaacaactccacttccaccagcagcctcagccggccgcagcctgggttctgccaggccccaagaagcccacatcaggttcatgggaccaatgggggaagctgccaagtttgttttgctttttgtttctccagcatccagcccagaacattccaccaaacctgcatctccaaatccttcccagttgggtgaagctcaacagctctggccctttttccctccttttctgcagaagagaacattgacccggaaggctgaagtgagccagctgcacctgccacacaggagtgtgcttcctccgctgctctgccttcagcctggacgatggcattcgggactgcaggggtcgcactgcccccaagggctcctctttgaaatgtataattgccaggagcaggtggagggatgcatttttcagaggcaacaatcagaaaaacactaagcacacttgggaaggcaggagggaggaggacacagaagatagaaagtggaagagatagggaaggaggagatgagagaccctaaagatcatcttgtctgagatcaaccctgcagctttgacaacagttgcacagaagtgatctatttttttttttttttaattttttgagatacggtcttactctgtcacccaggctggagtacagtggcatgctctcagctcatagtggcatgatctcagctcactgcagcctcgaacttctgggctcaagtgatcttccgacctcagcctcctgagtagctaggactacaagcatgcaccaccatgtctagctatttttttttatttttatttttggtagagacgaggtcttgctatgtagaccaagctggtcttgaactcctagcctcaagcaatcctcccgcctcagcctcttacaagttctgggattataggcatgagcaactgtgcctgaccagaagtgatctacttaaatcaatatggcctttttattatggtctaacagcaaggagctgagggcagaaatagaagacctgaaaggacttggaaagaaaagacaaggaggctcacccagccctgcatgagctgtccacagcccagaaggaagaacccctctaacccctcccatgagtgctgggactgtggagtcacacaggatagatagatagatagatagatagatagatagatagatagatagatagatatagtgctccagctccacccaccacctggaagtgacctaatcttttggtgactaaatttcctcatctataaaatggagggtaatgaatacacccacctcaaatgtttgagggtaaggactgaatgggataatacatgtaaggcacccagtatagtgcctggccccagacactcacttggctcgctcttcagccaagaggaccctcttgtgtcatctatttggggcttgctcttttttcctgtagctggtgctaccctggccttgggaggtcttccacactccatcccagaagcccaggaagaagggtgcagggagaaggctgtcccacccacaggcagcctgggccagccccgctccggacctcagagacaagtgtctcctgagttgccttccacacctcctctttgccagcctgttccagaggtaagacccggagggccaagattggtgtggagtatggaaagggggccagtgaggccagccaaggagcctgcagctgtgcctggatctaggggatccagagggccctggagatgctcgcacaggtggtctagcccagtcctccaaagccagaggctcctcgggatttggggaatacctgagcaaacacagaaggattatgtgcactcgccagagggtcctctgtgtgtgcaatgacagaagttgccctgggggcagacgtatctacagaaggcagagttaaaggtgattcggttgggctggggctagcagggaaggcttcaaggaggaagtggatactggagggaggacaaggacctggatgtggagccagacccagttggcagaagctgagtgaagccctttgtgctgtggccatgggccaggctgacagtcagctctgctgggacagtgtctgggggactcctgcctcagctgtcctctgtccctgtgactgaagtgggggatgttttcctgaggcaatgcatgcaacactgcccaccctacaggacagaggccatcaccatgagggcaccgctgcctccccctgctctctgagcagttgctgggcagacaggcagctaggccagtccagagggaacagggttgcagctgaccatggaggacaagtaccctctatcctcctctgccttcccagaggggccatgctcggtgaggggtgttcaggaggaggtctagtcagttagcacaggagcacgtcatctgccttcactgccccgtctctacttttttttttagacggagttttgctcttgttgcccaggctggagtgcaatggcgtgatctcagctcaccacaacctctgcctcctgagttcaagcgattctcctgtctcagccgcccgagtagctgggattacagacatgtgccaccacgcctggctaattttgtatttttagtagagacggggcttctccaccctctctactttttatacctcacccccaccaactgtcagtcttccttttcccacccagaagcccacaaatgtcagcctgccctactatcagctcttttcaagagcgaattctctggcaattccagcctgtgaatgagtttctgattctaatgtgtttccagaaaggggacaacttttcaaagacagtgccaggagacaaggttgaatccaaagggataaatctctaagggaagactcaggaacactgaaatctaagttttctttcttaccaatagcctttactatttcctcgcttaattcattttttttttttacacaattcacatttattgagcacctactacataacaggtgccacgctaggttctggcaattcaaaacggaagatgcacaacaactgtcttactgagacgatggaagcacaaacacatgagaaatgtcttcacaggccttcctacttgtgcaaaacacccacttaaatagaaatatttgctgattgaaaattattccggctgggtgctgtggctcacgcctgtaatcccagcaccttgggaggctgaggcaggtggatcacttgaggtcaggagttcaagacaagcctggccaacacagtgaaaccccgtctctactaaaaattacaaaaattagccggcgctggtggcaggtgcctgtagtcccagctactcagtaggctgagggaggagaattgcttgaacccgggaggcgaaggttgcagtgaatcaagattgcatcactgcactccagcctgagcaatggagtgaaactctgtctcaaaaaaaaaaaaaaaagaaaaaaaattattcctatatgctcattaaatcagttcccctaaggatgcttattggacaacacttcatagacctagacttgaaattaataaagctatatgtcaatgtatatcttatagctcacacctttctaattcagcctgtacttccccagcctgtgaccaataagaagatctgaccacagccttttatgagcactatctggcttgaatttgctttgtagtgctgtttggagttttccggactaatcatttggactggctccttctgcctgtggctcctgcttgagtatatacaatgtatgagtcatttgcttctttgcccctcttcatcctctggttatatttggtacttcctgacttcctttccaaactgttaataataaataacaggttgtaccacacttcaacaccacacaactatagatagcaaaacatggcatgcactgaattattcaatatgtgaataataccatgaagctcatcccatcttccagatttggagagttgtcaattgggacaatgtacgtcgtgtcctcgttaggtcctcccccaagctctgcacagctgctgccaggagctgtcctgcccattttaaagaaggcagaagctgctcacacgccagggtaaaaactccagttccattctaactacgttaaccattatttcccacatgtggggactctacgtactgcagtccttcaactaggggggtacttcggggtcaactagaaatagagatttgaaattggaattgtcccaggaaaatgtgggaggtgtggtcatgccatttattctgtgactaaggaaattcttgctcaaatgggagcgctccagaaggaagtcaactcagctgctaacaatgttgcatcaaaggcacctgaattccaaaaccaacttgacagaggtcagctgtgtctctgaccctgcaggctcccggctgataggaaagaggaagctggcccagatcatggagagaggggcagagaaaataaagggcaagaggagtgagaaagggagtagggaagcaaggacgtggaggagagagggaggcaatggggaggaagaaaggaaggatggacaaaaacaggtaacaggaagaaaggcagaggagaacacaggtgcagtgagggctatgagaagttacaggtgaaaccgtggaaagaggaaggaaagacaaaagatactggcagcaggaaaagttaggaatggagcccatgcaatgacaatggtttcagccactgactggagacatctgccaagaaacagcttcccaggggcccgtcggtccgccttgctcacttgactcgcctttctatctttctctttcttttcttttttctttctttctttctttctttctctctttctttctctctttctctctcttctttccttcctttctttcttttctttctttctctcttctttccttttctttttctttctttctctctctcttctttccttcctttctctttctttctttctttctctctctctttcttttttttgacagggtttcactctgtcactcaggctggagtgcagtggcacaatctgagctcactgcagcctctgcctcccaggttcaagctattctcccgtctcagcctcctgagtagctgggattacaggcatgtgccaccacacccggctaatttttgcatttttagtagagatggggtttcaccatgttggccgggctggtctcaaactcctgacctcaagtgatccacccgccttggcctcccaaagtgctgggattacgggcatgagccaccatgcttggctttgactcgcattttctaccccaaacctcttgaagaactctcccaggagtccagtagggaggtacacacttgctgacttacctagactgctcaccacctgggaggcagggccgcttagcagacaggccagcatgggaggctcagcttcccaggacaagcatgggcccccaccttacccgtgatgtccagagctccctctgcacttccatggaaagaactgtggtcccaaaggccagcataagaccctccagcccaggccacagcgtgcgaccatccccacaccctcgggcatgtctgtggacatttgcttgactggtttctgacatcagaatctcatctttctcaaagcattgaataaaaacatacatatcaggggtccttgaaaaacccattacttctctgcagggtcaatttaatgtttgtgtgtcaaaatcaccagcaacaaaaatgcaagcctctctctcagggaaacggacgtgagagttaccccctccttaaaaatacaaaaattaagaaaccaaacagcttaatcagcccctgggaatgcttagctggcaggttccagtcatacccagctcccagcagagacagtatcctgcctcatctgcaaaaattctccacaataccctccctgcaatgagtgtgctcagcctgagaatattccatttttattcattcaacaaatattactgatcaagaggaaatagccacatgatggggcgcatagcaaatctcagcaccaccttgatggaaatggttctgctccagccaagggcaacctcccctgtgggcagggcagggagtacctgggcaagggacttcagagaagcagggaacacccacctgacacccgcttcttgatgccacccacccacacacacctacacacacttgctggctgatatccgaaatccctgcagcagggacagagctttggcccccacccctaaatggaggtttgagaccaagactccccaccctaccccctgatagaaggggccagtgaatccccgcttggttgtggttgggtcctatgcctcacccttcaaattcattcaccttcaagttaaaggaaccaggtgggataccaaagtgcagggagtttcgagccaccagaacaagacctgcttcttccaccctaggaagtggacaatgtggcaggggctgcagggccaccccgggttgagcttcccccactccctggccttttgccggggtctgtacctggagctggagtcactgccgctctgcactgctggatcatccgtgacattaaagagccccgtccaattggtcagctggtcaccactctgccaaccaaactggaggcctctggcaagaaaacgaggcagtcggtactcatgctcatttgctgggttaagcctgcctaccagagagccacattctgttgctgtgcccaagtgacacattgccttggtcatgcaattaaaggaggcgatggtactgactccaaccatgaggatggtgatcataaaccacagccctctacagtgctctctgcggttctgcatctatcccctcattccatctgtaccagcagggctgagagcacacatttcacacacagggacattgcgactttgcgagacaaaggtcgcagagctcttctacctcctataccgtgccatccctcaattcctgcctccagttaaaccaaaagagcgccagcaccacattttgtcctcctcaaaagccagacacacttcagagcttttaataaaatctacagtattccagcacacaaggataccacttttggttcaagacgtgcactcagcacatgcttatcttcactccttccccaaccctcactaaaatgacagcaaagggataaatacagacatgcatgtcgggagaaggccatagaaggggccagcaataacatgctggatgatgaaaagcacaaggtcatggacctccaccagacagtggacatcttacttcctgcaaaaagcagatctactcgcagtgaacaactcaggaaggctcaggaatgaaaggtccccagggccagcgaaggtgggagtgcacaatggagctaagagcagcattgtttgaagtctgcacaaaaagcagtcagacaaccctctccccaacgccctgtgaattcccataccaggccctcttcccaagcccaggcagcctggccactccacctgcccacctcacagatgtcaggagattgctttctggggaaaccgactcacaggagttctgcgctcttttctcttatcagagactctgcactgaaaacagtggatgtgcctgaaagtctgcttactgagtgcacctggcttctgaatgcttgggtcacacaccctgccttccaggtttgctgagggatgggtttctcaggagggaaactgatccgctcaaaagaaacagatatggaggaaagggttggtgcccgcttaattgccccagggcaggctttctcagcctggcactatggcatctggggttggctacttcattgttgtgggactgtcctgtgcattataggatgctgagcaacatccctgctctctaccaccagatgccagcagcattgtaccctggaccctcctgctgcagcaatcaaaaatgtctccagacattgccaatgtctactgggggcaaaattgccccagttgagaatcgctgtctataacaatccacagagcttccaagaaaccttctagtgactggctggcccttaaatataaacaagctattaagaccatcatcatgtgaagaaaactttaacagtcagagaacaaaacaaaacaaaataaaacagaacagctttctctgctcatgcccagtgtggtctcaatatgcagaacaatgccagtgagttcataaacctgtacctcccatggaaatgctccaccagcaaccattggtgccgaggaccatgggtccatgcaaaacgacatgggcgagattgacaaggttacgggcaggtttaacgaccagtttaaaacctatgttatccagagggccattcgcaggatgggtgagtcagattattccattctccgattggccaaagccaacagcatcgccccagaaagaacttttgactggacagaatcatggatgtggaatatttctctaaataaatagtgaggccaggcttgatggctcatgcctataatcccagcactttgggaggccgaggtgagtggatcacctgagctcaggagtttgagaccagattagacaacatggtgaaaccccatctctacaaaaaatacaaaaattagctgggcatggtggcacttgcctgtagtcccagctacttgggcggctaaggcgggagaatcccttgatcctgggaggtggaggttgaagtaagccgagatcacactactgcactctagcctgagcaagagagtgagaccctgtcttgaatgaatgaatgaatggatagatgaatgaataaatagtgaaacacttaaaaaaagaatgcagggggaaaaagacaaatgaaaaaagcagaaggccaagcgtagtggctcatgcctgtaatcccagcactttggaaggccgaggcaggcggactgcctgaggccaggagttcgagaccagcctggccagcatggtgaaaccctgtctctactaaaaatacaaaaattagccaggcatggtggcaggtgcctgtaatcccagctactcagaaggctgaggcatgagaatcgcttgaacctgggaggtgaaggttgcagtgagctgagatcgtgccattgcactccagcctgggtgacaagagcaaaactccatctaaaaaaaaaaaagaaaaaagcagaattttttttcaataaaacccttaataataaatagcctctaagctaagggaatggggcagcagatggtcactggagctgggaactgatccatccatatctccactaataggctgagtacctgagtctctgcacctctcaaggcctctgttcccatctttcaagaggactgtctcagttgccttcaaagtctttgactgcaagtatcacagatctgagccttcttctatgatgcccacgcacctccctcttcagaagtctagctcacctcctacgtgtgtgtcagcttagtctcccagccagaccctgggctgaggaggccccttggggccctgccagcagctctctgctgcacacatgaagtgctccagcgatgctttgctgagtaacagtagaccctgttctcatactctccaggctccacagcagtggggagctcagaggaaaaggtacaactcacagggcagaggccgaagccaaagcaaaatgcctgtccagttcttagtccattcaaaacacagaagggctccggtctggttctgattcaatagttattcatttatccatttatttatttattgaagtggttgtttcctttcaaagagatcaccaaggtatttcttggagaaaatttgggtttggtttattcagaagagagacactttgagcacctattatgaacccggccctttacataaatggtctcaattcctacaaacgcctcatgcagaaaatctcatgatcgggccaagcatggtggctcacacctgtaatcccagaattttgggaaaccgaggtgggtggatcacttgaggtcaggagttcgagaccagcctagccaacatggtgaaaccccatgtctactaaatatacaaaaattagctgggcatggtggtgcgtgcctgtaatcacagctactctgggaggctgaggcatgagaatcacttgaacccgggaggcagagattgcagtgaggagagatcatgccactgcactccagcctgggtgacagagcaagacgaaagaaaggaagaaagagagagaggaaggaaggaaggaaggaaggaaggaaggaaggaaggaaggaaggaaggaaggaaggaaaagagagaaagaaaggaaggaagaaagaaaatctcattatctccatttacagctgatgaaatatgcagcttagagaggtttagtagcttgcccaagtaacaagtagctaagctaagatttaaaccgagggctaactctaaatgcttctactcctaaaagtctttaccaaacagcctagaggccaagaaaacagtaatatttccacccgagattttgcaaactagttagttcacaaacatatcaaatcaatgtccagcccaggagtctgctacgaaactcatgggtccttaaaaaatagtctaaccagctagacttcttcccacagcatgcatgaagggtcagctagccagccacactgtcatcctcctacccatggtgagaccccatgtcccttcacatggcagtcccctcccaggactatagaagcgagggactactgagcagaaaatatgatgacttagcaagacactcattattaaatggcacgggtggggggggaacaagttacaaaaggagatacccaatagtagttccatttctgtaaggttttataccagaaagctggttacttttgtaggtggaattaaagtttattttttcttttagtttagcaatgtttactcatttacctcaaaaaaacctaactgcataattttcaaaaccaatgtattatataatttaaattccattcctgagctaaggataggatctattattagtcaaagaaacccaatgaggaaggcctgtggaggtataaaggaagatgacaaaatgaaaaaacatttcatggctgggcacagtggctcacgcctgtaatcccagcactttggtaggccatggtgggaggatcacttgaggtcaggagtttgagaccagcctgaccaacatggtgaaaccccatctctacttaaaaaaaaaaaaaatatatatatatatatatatatatatatatatatatatcctggatatatatatatatcctggatatatatatatatccaggaatggtggtgcacacctgtagtcccagctacttgggaggctgaggcaggagaattgcttgaacctgggaggcagaggctgcagtgagccgagattgtgccactgcactccagcctgggtgactgagtgagactctgtctcaaaaataataattaaataaaataaatttgtaaaaaaatttaaaaaataaaacattttattcactcattcatttatataacatttgttgagcatctactatgcattaggaactggtagttgctgggccaagtaacagcaaagagcaaacgcttgtttccaaaatgctcaccataaaattgagataattacactaacacacatagaaatattagcaaacaagatagggcaaaatcaagtgcttaaatggagtgctgtaactggttttttatgtctaatttattttttcaaaaagaaaagatttgaagtaaatacggcaggatgttaacatttgttaacactgctaattctcagtcatgactgcatgaatgtttgttatattgttctccatattcttttgtagtctataattccataataaaaatacacgttaaaataatttttaaggccaggcacggtggctcgtgcctgtaatcccatcactttgggaggccaaggagggtggatcacgaggtcaggagttcaagaccaacctggccaagatggtggatccccatctctactaaaaatacaaaaaaattagcccagtgtggtggcgcatgcctgtaatctcagctactcaggaggctgaggcagagtattgcttgaacccaggaggcggaggttgcagtgagtcaagatcacaccactgcactgagcaaacagagcgagactccatctcaaaaaacaaacaaacaaacaacaacaacaaaaaacaagtgcttaactgtgctaaactcgtaatcactaacaaggccttagagtagccaagggcagcttcctggactcagtcagccttgcagaatctttgcaccttgcaggttaagctagaattgaacacagccctgaacctaaggaaacagaacatataagaattatgtaaactgatttattcaagactggattcagatatttagaggcctcaagcactgaaaagtgtgtggtgccacctcacgcccatacttactcaaaagttatgtgcctgttaaaataaaaatagctctgtctggattttctgattataaaatctgggatatgtttatggaggctcagcttttctctgttgtgtggttattgctgacaacctggctcagccaggtccctggttgtgtaacccacagccatgtaacatagccccttgctctcatggcaatgaatcctacagccatcagaggatggggaaagctgcccatgcttccctgagccaactaccaggggaatttcaggacagaaggcaaaatcacatctcagagaagcaatttaaaaacaggtggaactacctccattaataataccctccaaatattgtaaggcattatcttattaaaatttttgccaatggattaaaatatatatatgttccaggcactgtgacagatttacatgttatttcaaatcctcccaaaagcctataggtgggcattagtatcaccatttcacagatgaggaaactgaacctagggagattagatttacaacctgcccagatattgtgaagagcagagaaagtattcaagcccaagcccggcgtcagggcccatgtttcttccttctctcctttaaccccatgttctcatgctcttttttggggaaaaaaagacttttccattgtccaatatttttaatattatttgagctgctgccattgctgtggactgtttaatgacgaagtctatataaaacaaaccatgcatgggtgtggtggctcacgcctgtaagcattttgggaggccgaggcaggaggatcacaaggtcaagggatcgagaccatcctggccaacatggtgaaaccccatctctactaaaaatacagaaattagctgggtatggaggcatgagcctgtagtcccagctactcaggaggctgaggcaggagaatcgcttgaacccaggaggcagaggttgcagtgagctgagatcacaccactgcactccagcctggtgatagagcgagactccatctcaaaaaaaaaaaaaaaactatagagtattataaaatgaagaggctgaacaaaatcatctctgagatcctttcccattttgattgaagtgccaaagttacagaatttctggcactggaggaggccagtggaggcaattttgtgggggacacaggaaggggaggaagtggcacatgcgtagctatccattcacagtgtgtgggctcctgcacaatctgccttcgcatatggtaggcctggggccaagcatccgcgagtgcccactcagatgctggaatctccagggtggttgaaccaaaagaggctgaatctatggggcacagggcatttggcactgtggacttaggttccccaaagaagccccacccctgatgccagagcccaggaccccatgtgctgactgctcaacccagtggggcacagcgtgcagcccaggtcaccaagagactggccatgtgctcaagacaaaatgcaactgaacccatccttgcaaaccacctccaagagcctcctgcttcaggctgaggcccccccacatgctctggagagtgagactgaagccactgtcattgctctgctctgtttttcaggtcagtagaggacaggaaggcagctgcttcctagatggtctcctaggtcttcatgccttccctgtccaacggcctgaacactgccatcagagtgagcttcctaaggagtatcccaatagcaccacttgcctattccagaaccttccaagactgcccacgacccaaaggacaggatcagaccctcaactcagtgccccaggagtggccctgcagtttcacttgcacccctctgcaaacctcagctttttaagccactattgtgctcccacaatcatcctgcgccccacctgcctcaatgtccctcaacctccaacgtccagctcaagcaccaccacttccctgaggcccttcttgaccactctggcccagcccaccaggccgtcccaccttggaactaagtcagcacttactctccaaccccctacaccttctcatcctgcctcactcagcggtcacctctgcctgtctatctgtgagttctgtcacccctacataattatggtccttcctagggaagaaactagactttatatctaaaactgagccccaaattgtctttctcaaagtccttaagcaaccagagtggggaaagggggccaggggtgggtgccttgaactccaccctccccagaggtctccttaggaaaattggaacaggagggtcttaccagtcctgggaaagaggaagaaacagagagaggggaggccagccagaaacacatgccagactgcttgttgagtccaaccctcctggggcaggcaaagggactgcagccatagaggtgttagaggtgttgccaggcaaactcccacccaagagacaagttttacagtggataatccagagctagtaaggggcaccaggcagggaggggtatgacttgaaggcccacaggggctgtcccctgtccctaaagtatcttacccattaacctgtcactaagactccaaaagaatgacagtgttgcgaccaacaattacaaacggacttcttcagtgttaggagatactgctgctgccctcaagaactgacagtccggttttaactgttatttgggaaatgaccaccttgcacaggtggggtcctcggaagagtccagaggttagggggtggtgagaggacagaaaatgcagtgaactggaggaggccaggccagggttctactaagaactgcagcactaatcccagaaattgttagttctcagtgaggggcaaatagctccaatgctaaacagcctttggcaggatttcaggcagaagtgccagtttgatgagggagaaggttctggataagaaggtgttatcagtgcctctccatcagtcacaaacctgcagctgccatgttcctttaaaggtgttaacaccagccccagaagtggccactttcttcagagcttcaatagccatccaagcagatgactcacctccaggcaatgcttgcctctagagattcttggataggggggctcgcattccaccattcactagcagtgtgactctcagcattgaacctcttgaagtctcagttttctcatccgtcaaaggggatgaataatcctcaacctaaggatataaacagtctacaaaagcagacatataaatgctaacatgcatataaaggcttttatatctaatatacacaattaaaatgtatttaacccaatgtttgcataaagaaaagataatggagtggttgatggacaaggtgagaagtcttcctttccatttgtacacacttttgtaacttttgattttatacatgcttgcattactttttcaaaaaataaacaaaagtaggcctggcactttgggaggccaaggcagggggatagcttgagctcaggagtttgagaccagcctaggcaacatagtgagaacctgtctctatcaaaaaatcaaaaaattagagcttaggaggctgcgtcaggaaaatcatttgagcacaggaggttgaggctgcaattagtcatgatcacaccactgcactctagcctgggtgacagggcaagatgctgtctcaaaaaataaaaataaaggaaataagcaaaagtaggctgggcacaggagctaatacctgtaattccagtgctttgggaggctgaagtgggaggattgcctgagacccagagttaaaggctgcactgagctatgattgtgctactgcactacagcctggatgacagagcaacaacaccctgcgtctaaaaaagaaaaaagaaacaacaacacagatggtcaccccaactaccaggtgaagtgaagatgaactatgtgtgacaaatggctctgtcaactacgtgagcgctagttgtttatccggagaagatgcaggtagcgggctgtagctgcctggttatgtcaagggggagatttctttctgtctttgcagtctcttagcagattgcctgtgatgagcactacgttctgatttaatgcttattcaatagtaaaaacattttatttctctaccaaaagaaaaagaaaaaggccttttggtaactcttttggcgttgcacaaacaggagggatggtagcgacgatgatggctggtattaacacaaaaatgaaaaataaggaaaacaaaacaagggcagttgtttcatgctgagaatgtcatgtctttctcctgagtaactgctactacccatacccctcggggaactagaggtcactgagcaccgggctcagggccccttcacctccctctcgccccagcaggagagcccaggcccctgtggagggcgaggactccaaggatcagtagccagagtggctgcagccactgatctgaaagtccttcctgacccaagtcttgaccaagaacaaagccaaatccacttcttctccttaaaacaactcaatcttaagccagcagccaccccagaacagacgcccttaccttcctgacggatcccatcctggccaggggagggccctgctcatcctatgaccatcatctctaaagttagggatggcaccataacatgcacactttcgctcaagaagctctccttagagagctcctctatgctcttcttggaccttttagagcatcacgcaccctgggtaaaacagccaataaaagtacaaccgcacattaatcatttatatttctacaaagtgcttcacttctaccagggagcaaattcaaacctgggcatgaggggcccagacagagaacgagcagagcgaaggcaacaagaacaggggagggtgtctgtgctgcccaagttgtgggaagacaggcctcgggttgccactttgctcatttgtccaagaggggcaggaagtccaggcttttatttttcatttcccagttcttaaaggttgccaatgaatccaaacttgaaacactgtgcagaccaaatacgacacgctgtaggctgcagaccacccattggcagcccctgagttgcagcatcttgctccatcctgaccccagtcctgtgagggagagaggtagagtgcaccatcagccatcacagctgaggaaacaggcatagagtgggaagttagctcaagccacctgggggcaaagataggcctggaacccaggagtcctgactcccagttcaggcctctcagcacccaaggtctggatcctgtcccgggagtcagttgcacccagcacacattggggtcttcccatattggggtgctgggtcagtgacctcagccttctggcctcatgcacaacacacctgttcacctttactgctatcctcacactggcccaggtgagcgcattccagggccctgcctgtcaccaccccctccctcttgacaggcatacaacaggaatgagaatgactgtactccctatcattagagggataaccttgagtaggctctattcgtaaaaaaacaataaaagaagaaaatcattcacaaacgttgctatttaacttttgtgggaggataatctattgaattattcatttgtattttccctcctccattccagaaaggtagctcggttttcttatcttcaacccagggccaactgggttgtgggggcgaaaggcttcaatgctcaagaaattgtgctgtgaagaaactgtgtgagagagtcctgggggaggtggggggccagtgcctctgggtctcgggagggctggtggaagtggtgagaccatggcccaaaccaggaagcccatgctagcagcttgagatcgctctgtccacatccctcacaagggatagcaggacctcagaaaggggcagctcgggaggctggacccagggctccagaagcctccagaaagcagtgagcagatcagcagggccagcacagcccagggggtccacggcactgttctgtcccacacaagacccccagggtcttcacacaaccctgggagggggaagaccccgaaggcggctcaacactggtggattcaacttcccacaaattggtgggtaaggtttagtcatgtttttaatgaaagaaagtttaaaaatgagccatttctttcacaccaagccaagcttgtgaaataaaatgtataattgcttttctattgttaatcagcaaatcacttgcattggacctcacagtgtatcgagggtacctttccttttcccattcattctattttcatcttgttatatatgcataatatttattttatgatattattctatattggtccaacagccatcccaggccacatactgaggctcaacagcgagcaagccaccaaagccttgccccagtgactcttaatttctaccagagggagacagatatgacgacaataaactaacaggcgacaaaatgcgtcatacgctaaagggtgaaaggtgttgtgggagaaataaagggaggaaagggggataaggggcttggggtgggggaggaatgttattccacacagggcagtcagggaggcctctctgggaaggggacatgtgagcaggacaggaagtgggtgatgaggggccagcccaggtggatgcgctaggtgaggactgtcccctgcagaggcagaggtgaggggaggatgagctttcactggggccaagtgagccaggggcagggtggccagtgatggggcatcagttcatggaagaaaggaacactgcctttctggggtccctcaaagccatgtgagaggaaggtgagtccaatttcatctctggaggagccaagaactcagccaggagtctctgtgggctgggcccagaatgtaggcttctccccgtccctagggggctctgaccgcccttcccccacctacctcccgaagccctccaccatccccaggtccaggtaaggagatgggcccctcagagaaggtgccaggaccttcccacccagattagagcggagatgcttctggttgcgccgcattctcagcaggatgaacgggcgcaatgaccaggttctgcgctcccttgcctgtccatgctcctgactcactctgtgacttacgttactttcctacgaagctccagaggataacaattccctcatcagaaaaaggaaggggtttcattcaccagggtccacctggggggcctttcattggaggcaaaagaaaagatgctgcagggcaggagtatctggagggaggagaggaacggagagacccccaacccctaggccgttccccacctccccccacccctgctctccaccctggcagtacacctggggttgcctctctaatcttttgggcagaaatttcactcttccttttccaggctccactcaaagcctaaatcttgtccagtggttcccaaattgactccgtggaacactgggtcaccctttgagcctctgcagaggagaggagggaaaatggtggaggtagggtttaggacaagggaactaggtaggcaggactggagcccccatcctgtttcaagcagagcatccttccttctaaggtgagcatgggctcctacacagcccttagccagaggggtctctctgccttctgactccagcagcaatgaacaagagtttgcactatccacttggcacttagtatataagatagttgtaaactcttcatgtgtgtttgagccttccctgccctaccccaagagagcaccctgtttcatccatcttggtaaatgtgatggttaactttaagtgtcaacttgattagattgaaggatgcaaaatactgttcctgagtgtgtctgtgagagtgttgccaaaggagattaacatttcagtcagtggactgggagaggcagacccacccttaatgtgggtaggcaccatctaatcaactgccaatgtggctagaataaagcagacttactgagtctcctggccttcatctttctccatgctggatgcttcctgccctggaaaatcggactccaagttcttcaacttttggactcttggacttaacaccagtgtttgccacgagctctcaggccttcggccacagactgaggactgctctgctggcttccctacttttgaggtttggggacttggactggcttccttgctcctcagcttgtagatggcctattgtgggacttcgctttgtgatcatgtgagtcaatactccttaataaactgccctttatatatacatctatcctattagttctgtgcctctagagaaccctgactaatacagtaaccaacgtctatagcagcaccaatagaaatataccaggagtcacatatataattttaaattttctggtagccacattataaaaaagtaaaaattcatgtaataaaattgcttagaactaaatacacagacttataaataagtgcatgcaaaattggtgaaatgagaattgatggattgtatcaatgtgaatttcctggttctgatattgtactatattgtttggggtgttttagtttttgagacagggtcttgccctgttgcccaggctggaatgtagcagtgctgtcatagctgactgcagcatcaacttcctgggtccaagcaatcctcccacctcagcctcctgagtagccaggactacaggcatgcaccaccacacctggataatttttttttttttcgtacagacagggtatcactctgctgcccaggctagtctcaaattcccggggtcaagtgatcctcccactttggcctcccaaagtgctaggattacagacatgagccaccatgtctggacatgatattgtactatattgttttgaaagatgttatctttggaggaaattaggggaagtggatacaggttctctctgtgttgttacagctgcgtatgaatctacaattctcaaaaagatttttttaaagtaaaaagaaacaggtaaaattcatttcaataatatacttattctaacctaatatattcaaatattatcatttcaacacacaaacaatataaaaaaattaaggagatacgtcacatcccttttttgtattatgtcttcgaaatccaacgtgtattgtatatgtacagacagcatgtctcaactcagacgcaacacttccagtgctcagtagtcacatggggctagtggctagtggacagtgcagggctagtacacaaagggcacacaatggatgctttctgcatgaatgatgaatgaaccaattaaccaacctgaactaagaggggcctgagattggacctgcagaatagcacctcaccagcagaagtgcaccgggtgggggtaggggcacatagatgtggggatattggctctgcaggcactgctgggtggaaagagaaccccctaaaatgaacttggattagaaggaggacaaaaacccagcctaacatggaaggaagagaaagcacttgggaattcttgcttcctttaaaccttcttttgggggttgtggggtgtggtttatttccaagaaatggcaatggtggtcttaggaagtattgatcctttgatctgctgaggaagaatggggagttggcaggttggaggagtgaggggagggaggtttggccttcctttgcccagatactcggcaaatgcagcacaaaatcagatggaataccaggctggagtgagcgtggatgcattttattctcccaggacaccccccgctgacccagtgtggcattaaacccccagaacccccacagtgtggcatcccatacacatatcctggcttacctgccttatttccattccctccacccacacagtccaggggctctgcaggacctgtgggccccctggaaggagccagcaaagcccagcctgagctgttctcctgagggaccagtcccttgtgccccacgtcaccagagctggaagagaggaagccaccttgcccacccactcacactgcatgaggctaaacagagaccagacaggccgtcagtcagcttcacagagctatggtgtctaaaaagaaactttcaaatctttgatagcttccatcacctgctcctcctgcctcaacacctcagcctgtcccccagatatccccaaatccagtctctgagacccaccagttcttcaaagcctctgtcaggtcccaccagggtactcccaccccgccccattgctgtctcctctgaaacctacaagatttatagtctatgccacaaaattgcgagtttatttatacactgtcttacataatttttcatgtttgtctctttaagtgttctgtaagtttcttaaggacatgaatcataccaaataattctttagtagcatcccctctcccccagcgcaaagctgagagggcgtttaacgaatgtttcttgattgttaggataaagtttcaggattcccttcgtatgaatccatccattcaacaattagtgtcaggcactgtgctaggacctgagaacttagagatgaataaagcatctcttacaagggtcttaccagctgtgtgactttacacatgttacttcccctctctgcaagaatatgaaatgaggaagactatgtatttaataggactatggagaggattaaatgaaataatcttcatttaggattagcttcttaggttagaacctgcctcatgatcccttagtgaatgttaataattaattttttttttttgagacagagtctcactgtgtcgcccaggctggagtgcagtggtgcaatcttggctcactgcaacctctacctcccaggttcaagcgattctcctgcctcagcctcctgaggagctggaattacaggcatgcaccaccacgcccgaataatttttgtatttttagtagagataggatttcaccacgttggccaggctggtctcaaactcctgacctcaggtaatctgcccacctcggcctctcaaaatgctgggattacagacatgagacaacactcctggccaatagttaatattattacctcatgaatccttcacctgtggggaggaggggtgtccctagggtaataggtagggttaagagctaaattagagaattattagataagaagtgaatgacctggatacatcaaaaagaagaaattaaattctctaagaggtaaatccctggaaaatagaaatgtcaaaaaaaaaaaaaaggtgggtggggcaaggaagaagagacggaatccgggagtaagagggtatcactgtgctcctgagagatatctgaggaaggtacaggaaactcacatccaacacctggtgcagggctgggcatatggcaggtcagagccaggattagaggaaggccagcaaggcacccagcacacaacatttaaagaggtcctcattctcaggctcatgtaagtacaaagttaacgcctgagagtagaggccaccttaaattttgttccctggatcacttgctggcctcacctcatctcagttttgcagcaagtgctcaggagaaacttgctctgaccagcgaaactgtaaagtcactctgctgacccaccacacacccaggctgcagtcagagcagcatcccttctttccagggcaccctccccctcgagaaccacactctggatagatcctccagtccctgtggtcccaatctcctggggctgtgcctgtttctcggggcagtcgaacagaaggctttgtcccctgggtcgggggagagttggctcagtgatgagggccttcgaatatacacatgtaggcagcacaaagtcaggctgtacttttccttgacccagtttcgcatcctcaagtctcaggcctgcactagccacatgcaggcagcccagctttttgccctgaaggtgcaggagagaggaaggctggagggaagacaaagcataggagggtcctctgtacttgaggcaggacaaaactcctggtctcatttcctgtccactgcacaatcacatagaaaagcaatgggacagtgctgagcaggatgtgctaagtagagacaccatggtgctgtgaattcagaggagagaaagaacaccgtgggctgagaccagaaagagaagcaggatttggactgaaagacagctgggaggggacagcgggtcggaggcagcgtgggtgaaggcccagagttaggacagatgtgacatgcgtaaaagacccttcactggccgggtgtggtggctcatgcctgtaatcccagcactttgggaggctgaggcgggtggatcacctgaggtcagaagttcaagaccagcctggccaacatagcgaaaccccgactctactaaaaatacaaaaattaaattggcatgagcctgtaatcccagctactcaggaagctaaggcaggagaattgcttgaacccgggaggcggaggttgcagtgagctgagatagcgccactgcactccagcatgggtaacagagcgagactccacctcgaaaaaaatagatccttggctgacaggggagaaacattcaacttccagagtgggcttcagcacagactgacaattaggcatgagatttttgtttggggaacagagacattcaaagatttctatttccaacaaagtggccaactgagaagccctctggggcaggtgctgtgacataccccaccacatcaccttcgggaatgaaggacttctccccacctgttgggggtgccatgagccgacagccctcagctctcattcctctttgagaattgccacaggtgagcagagccaccttgctcaaggttatgtcctcttccagggcatatacctcttccaggtataaaggtcaggccccctcaccccaactctgggcaagtatgaagagacagcccagctccagggctgcctatggggtccactgaggctttctctggaactgtattgcagctcaatttctccctatggccagtcatatttccttctctctttctcagatattgatcccaagaacacttctcaataaacatcctacactctaatctctgactcagagtctactttccagggaatccaatctgcaacatcctcccaataaaaaacactaaaataacaattaaaatgtcttttaattgccttattaaattgatgaatagtctggcaagaaaagaagtagtagatgcattcgtcagccaatctcggtgattcatgcttcccttgtaatggccaaagggccctcccaaggagggtcacactgggaacctcctcctaaagccaagaaagcacaaataatgcaaaagagaagaagggagaaaaggcaaggtatgtgaaacacacaaaatatgatggcagaaataaatccttagtcatcagtaatcacaataaatgtaaatatactaaactttctaagtagaagacagagattgtcagactaggtattaaaaactgtaagtatgtgctagttacaacagacatagaatgaaagacatgcaaatttaaaaaaaaagattcaatatcataaatatcatgttctctcaccacaatacctttgagttaaaaaaatcaaaaagataaggaaaaacttgaagcctctggacattttaaagcacttctaacttcatgagtgagtaaattatgatagaaattagaaaataattggaattcaagatattgaaaatacatctggtatttactagctgtatgaccttgaacaaattacttaacctcactgtggctcagtttcctcatctataaaatagcccctggtaacagtatctattacttgtgttatatggattcagtatgttaacacataaagcacatggactagtaactggcacatcgtaaatgcaatgtcgttctgagttcttgttatcatcatcatccccaaattgaagagatttaattaaagaaatatttagaggaaattttataacttcaaaagtttacattagaaaatagaaagactgttaactgaagagctaagcacccaacttaggaagttagaaaaatgacagaataaaatcaaagcataaaaattaataaaatagaaagcaaatatccaagagaaaatcaacaatgccaaaatctgatcattttacagagacaatgtaaaaaacagaaaaagaaacaagtaaataatgttaagaattaaaaaggggcaaaccgatggatatgacagagatgaaatacagcatattataaattttgccaataaacttgatttcttttaatttctagaaaaatataatttaccaaaattgattgaagaaatagaaaacttaaatactcttacaattactaaagaaatggatcagtaacttgattaataagtcttaattagtaagacttaatggattagtaaagttttcccatatggaaaacattaggtgcagatggttgtagaggtgaggtctaccaaacatttaaagaatagatgaatctcaaaaacgtgcataagtcattacagagaataaagttttaacattctcaactcatttgcaagactgattttaaaaccaggcaaagatagcatgataagagaaaattacatccaatagcattcaagaaacagaacagatcatcctgaataaaaataatagcaaacaaaatctcacatcatataaaacaaataatataccataaacaagctgggtttacccctaaaattataagttgaacatctattaaagtaattgaccacatcaaaaggttaaaggggaaaaactacacaccattcaatagatgtagaaaaagtacttataaaattaatatctaaatacaatttttggctggatgcagtggctcacacctgtaatcccagcactttgggaggctaaggaggatggatcacctgaggtcaggggttccagaccagcctgagcaacatcgtgaaatcccctctctactaaaaatacaaaaattagctgggcatggtggcgcatgcctgtaatcccagcttctcgggaggctgaggcatgagaatcacttgaacccaggaggtggaggttgcagtgagccgagatcaagccactgcatccagcctgggtgccagagcgacgctccatgtaaaaaataaataaataaataaatataattttcaaaataagaaaaaacaaaacttttaacacattctacaaatgtgtggaactttacctattagaaaatatcttaaaaaaataagcaaacatattcaatgatgacacttttttaacattccctttacaattaggattaatcataccatatacaaaaattaactcaaaatgggtcaaagatctcaatgtcagagctaaaactgtataatacttagaaaaatgtttaagtgtaaatttttgtgatgttggattaggcaatggttccttagatatgacacctaaagcacaagcaatcaacaacaaaaaaaaaatagcagaattggacttcataaaaatgtaaaacttttgtgcttcaaaggaacaccaaaaaagtgaaaagacatgttttgcaaatcacgtacctgataagcgacttatacttgaaatatataaagaactcttacaactcaagaagaaaaagtaaaataatccactttaaaaataggcaaagggacctctgtgggcagggcatagctgaacaaaaggcagcagaaacttctgcagacttaaacgtccctgtctgacagctctgaagagagcagtggttctcccagcatggtctttgatctctgagaacagacagactgcctcctcaagggggtccctgacccccgtatagcctaactgggagacacctcccagtagggactgacagacacctcatacaggcggatgcccctctgggacgaaactttcaaagaaaggatcaggcagcaatatttgctgttctgcagcctccgctggtgatacccaggcaaacagggtctggagtggacctccaggaaactccaatagacctgcaggtgagggacctgttagaaggaaaactaacaaacagaaagaaatagcatcaacatcaacaaaaaggacatctacaccaaaacgccatttgtaggtcaccaacaaaccaaaagtagataaaaccacaaagatggggagaagccagagcagaaaagctgaaaattctaaaaaccagggtgcctcttcccctccaaaggatcacagctcctcgccagcaatggaacaaagctggacagagaatgactttgatgagttgacagaagaaggcttcagaaggttggtaataacaaacttctccgagctaaaggaacatgttctaacccatcacaaggaagttaaaaaccttgaaaaaaggttacaggaatggctaaactagaataaacagtgtagagaagaccttaaatgacctgatggagctgaaaactatggtacaagaacttcgtgatgcatgcacaagcttcaatagccgattcgatcaagtggaagaaaaggtatcagtgattgaagatcaaattaatgaaataaagcaagaagacaagtttagagaaaaaagagtaaaaagaagtgaacaaagcctccaagaaatatgggactatgtgaaaagaccaaatctacattcgattggtgtacctgaaagtgagggggagaatggaaccaagatgggaaacagtcttcaggatattatccaggagaacttccccaacctagcaaggcaggccaaacttcaaattcaggaaatacagagaacaccaaaaagatactccttgagaagagcaaccccaagacacataattgtcagattcaccaaagttgaaatgaaggaaaaaaggttaagggcagccagagagaaaggtcgggttacccacaaagggaagcccatcaactaacagcggatctctcagcagaaaccctacaagccagaagagagtgggggccaatattcaacattcttaaagaaaagaattttcaacccagaatttcatatccagccaaactaagcttcataactgaaggagaaataaaatcttttacagacaagcaaatgctgagagactttgtcaccagcaggcctgccttacaagagctcctgaaggaagcattgaacatggaaaggaacaaccggtaccagccactgcaaaaacatgccaaattgtaaaaaccatcgatgctatgaagaaactgcatcaattaacgggcaaaataaccacctaacatcataatgacgggatcaaattcacacataacaatattaaccttaagtgtaaatggactaaatgctccaattaaaagatatagactggcaatttggataaagagtcaagacccatcagtgtgctgtattcaggagacccatctcatgtgcagagacatacataggctcaaaataaagggatggaggaagatctaccaagcaaatggaaagcaaaataaagcaggggttgcaatcctaggctctgataaaacagactttaagccaacaaagatcaaaagagacaacgaaggtcatttcataatggtaaagggatcaattcaacgagaagagctaactatcctaaatagatatgcacccaatacaagagcacccagattcataaagcaagtccttagatacctacaaagagacttagactcccacacaataataatgggagattttcacaccccactgtcaatattagacagatcaacaagacagaagtttaacaaggatatccaggacttgaactcagctctgcaccaagaagacctaacagacatctacagaactctccaccctaaatcaacagaatatacattcttctcagcaccacatcgcacttattctaaaattgaccacatagttggaagtaaagcactcctcagcaaatgtaaaagaacagaaatcacaacaaactgtctctcagaccacagtgcaatcaaattagaactcaggattaagaaactcactcaaaactgcacaactacatggaaactgaacaacctgctcctgaatgactactgggtaaataacgaaatgaaagcagaaataaagatgttctttgaaaccaatgagaacaaagacacaacataccagaatctctgggacacatttaaagcagtgtatagagggaaatttatagcactaaatgcccacaagagaaagcaggaaagatctaaaattgacaccctaacatcacaattcaaagaactagagaagcaagagcaaatacattcaaaagctagcagaaggcaagaaataactaagatcaaagcagaactgaaggagatagagacacaaaaaacccttcaaaaaatcaacaaatccaggagctggttttttgaaacgatcaacaaaattgatagaccgctagcaaaaccaataaagaaaaaaaagagagaagaatcaaatagatgcaataaaaaatgataaaggggatatcaccaccaatcccacagaaatacaaactatcatcagagaatactataaacacctctacgcaaataaactagaaaacctagtagaaatgaataaattcctggacgcatacaccctcccaagactaaaccaggaagaagttgaatctctgaatagaccaataacaggttctgatattgaggcaataattaatagcctaccaaccaaaaaaagtccaggaccaaacggattcacagccaaattctaccagaggtacaaagaggagctggtaccattccttctgaaactattccaatcaatagaaaaagagggactcctccttaactcattttatgaggccagaatcatcctgatactaaagcctggcagagacacaaccaaaaagagaattttagaccaatatccctgataaacatcgatgcaaaagtcctcaataaaatactggcaaatcgaatccagcagcacatcaaaaagcttatccaccacgatcaagtgggcttcatccctgggatgcaaggctggttcaacatatgcaaatcaataaacgtaatccatcacataaacagaaccaacgacaaaaaacacatgattatctcaatggatgcagaaaagtccttcaacaaaattcaacagctcttcatgctaaaaactctcaataaactaggtgttgaaggaacgtatctcaaaataataagagctatttatgacaaacccacagccagtatcatactgaatgggcaaaaactgggagcattccctttgaaaactcacacaagaaaatgatgtcctctctcaccactcctattcaacatagtgttggaagttctggccagggcattcaggcaagagaaagaaataaagggtattcaattaggaaaagaggaaatcaaattgtcccggtttgcagatgacatgatcgtatatttagaaaaccccattatctcagcccaaaatctccttaagctgataagcaacttcagcaaagtctcaggatacaaaatcaatctgcaaaaatcacaagcattcctatacacaaataacagacaaacagagagccaaatcatgagtgaactcccatccacaattgctacaaagagaataaaatacctaggaatccaacttacaagggatgtgaaggacctcttcaaggagaactacaaaccactgctcagtgaaataaaagaggacacaaacaaaatggaagaacattctatgctcatggataggaagaatcaatatcatgaaaatggccatactgcccaaggtaatttacagattcaatgccatccccatcaagctaccaatgactttcgtcacagaattggaaaaaactactttaaagtccatatggaaccaaaaaagagcccacattgccaagacaatcctaagcaaaaaaaaacaaagctggagacaccacgctacctgacttcaaactatattacaaggctacagtaaccaaaacagcatagtactggtatcaaaacagatatataaaccaatgtaacagaacagaggcctcagaaataacaccacacatctacaaccatctgatctttgacaaacctgacaaaaacaagaaatcgggaaaggattccctgtttaataaatggtgctgggaaaactggctagccatatgtagaaaactgaaactggatcccttccttacacattatataaaaattaattcaagacggattaaagacttaaatgttagacctaaaaccataaaacccctagaagaaaacctaggcaataccattcaggacataggcctgggcaaggacttcatgactaaaacaccaaaagcaatggcaacaaaagccaaaatagacaaatggtatctaattaaactaaagagcttctgcatggcaaaataaactaccatcagagtgaacaagcaacctacagaatgggagaaaatttttgccatctacccatctgacaaagggttaatatccagaatctacaaagaatttaaacaaatttacaagaaaaaaacaaacaaccccacctaaaagtgggcaaaggatatgaacagacacttcttaaaagaagacatttatgcagccaacagaaacatgaaaaaatgctcatcatcactggtcatcagagaaatccagatcaaaaccacaatgagataccatctcacaccagttagaacggtgatcattaaaaagtcaggaaacaacagatgctggagaggatgtagagaaataggaacacttttacactgttggtgggagtgtaaattagttcaatgattgtggaagacagtgtggtggttcctcaaggatccagaactagaaataccatttgacccagccatcccattactgggtatatacccaaaggattataaatcatgctactataaagactcatgcacacatatgtttgttgcggcactattcacagtaccaaagacttggaaccaacccaaatgtccatcaatgatagactggattaagaaattgtggcacatatataccatggaatactatgtagccataaaaaaggatgagttcatgtcctttgcagggacgtggatgaagctggaaaccatcattctaagcaaactatcacaaggacagaaaaccaaacactgcatgttctcactcataggtgggaactgaacaatgagaacacttggacacagggtggggaacatcacacaccggggcctgtcagggggtggagggctgggggagggatagcattaggagaaatatctaatgtaaataatgaattgatgggtgcagcaaaccaacatggcacatgtatacatatgtaacaaacctgcacgttgtgcacatgtaccctagaactcaaaagtataattcataaataaataaattaattaatttaaaaaaataggcaaaggggctgggcgtggtggctggctgggcgtggtggctcattcctgtaatcccagcactttgggaggctgggaagggtggatcacctgagattaggagttcgagactagtctggccaacatggtgaaaccctgtctctaataaaaatacaaaaattagccaggcatgatggtatatacctgtaatcccagctactcaggaggctgaggtgggagaatcacttgaaaccgggaggcagaggttgcactgagctgagatcgcaccattgcactccagcctgggcaaaacttcctctcaaaaaaaaaaaaaaaaaaaaggcaaagaatctaaatagatatttctccaaagaagatatgcaaatagctaacaagcacattaaaagatgctccacatcattagtcatcagagaaatgcaaaatcaaaaccacagtgagatgtcacctcaaaaccactgagatggctataatccaaaaaaaaagataataaaagtgttatcaaggatgtagacaaattggaaccctcatacaatgctggagaaaatgtaaaatgatacagccaccttggagaaccctggcagttcatcaaatggcaaacacagagttaccatataaccagttctactcacaggtataaacccaagagaaatgaaaatctatatccacacaaaaacttaacataacagtgaaaaacaactcaaatgtctatgagttgaagaacagagaaacagaatgcagtctatccatacaatgaaatattattctgcaataagaataaatgaagtactgatacatgatatgacatggatgaaccttgaaaacattctgcttagtgaaagatgtcaatcacataggacaacatagcatatgattccatttatatgaaatgctcaaaacgggaaaatctagggagacagaaaacaggttagtgcgtttgctcattcctaggactaggagggataggggtctgggaagcgatggctaaggggtacaggatttcttttgcagagtaatgaaaatgtcctaaaattgactgtggtggtagatgtgcaactgtatgaatatattaaaagccatttaactctacactttaagtgggtaaattttatttcaataaagctgtcaaaaaaagaaagaagaaaacgatgaggactaaaatgaggatgttcactccgacacttttattgaatattatgtcaaaggtcctagccactacagtaaaacaagaaccatatattaaggtataatggtagtaatgaaagaaagaaaaatgtctacatagaaatccccagataatcttcagataaactattatcagtatgtgcataatcaaggttgctgattataaaattaatacacaaaaaacaaatttatttctatatgccagctacgaatggttagaaaatataactttttaaaagataatttgtacgataataaacattttacatagtttttaaatagttaaaaactatatagctagacatgaattgttacggactaaataattgtttgtgtccccccaaaattcctatgttgaaatcgaatcccaaggcaatggtatttagaggtggaggcttggggggatgattaggtcagagagtggagcagtcacaaatgggattggtgcccacataagacgaggccagagacttagctacctctctttcatccccacatgaggaaacaagaagtctacaacctgcaggagggccctcaccagaacccaaccatgctatcaccttgatcttgaactttcagcctcttgagcaggagaaacaaacatttgttgcttaagctaccaaatctatggtaatttgttatagcagcccaaacaaactaagatgtaaatctaacagaaaacattcaaactctttatggagaattataaaactccattgaaagacacgggaagacattcaaggcccaaggttatttggttttcctgagattaagtttaaaagatagactcagaccagattattaaaatctaccatgtcttttttcctacctttaaataaacattgccctttccctgtccctctgttaaagtgtaaacacctgaagttgtaatactctagggctgtgagcttatatgaagatttcagcactaacaaaggggattggggtcagtgggggacttaaaagaagacggaacaatttccatgcccctcattgtggaaaatctttcttttaatgctttttcttctcagcattgacacctagaaagggtaacctgcgctccctgtctccacattgtctttccccactcactccctgcccactgaaataggatcctgtccccacttctctctcccaaactgtctttgcctctactgccaacccagcagacacctcaatcctatcccacccgagccctcttcctggcatgccacagttggccactctcactctgacgccctcgtcccttggtttccttaacacctccctctcctcattcccctccacctctctccagcctcggcttccagagccagctctcctctctcgaccccttataggtgcagacatccttcaaggctctcctttgtgcccagacccatcatcattttccactctgctctgtccttggtgactcatccaatcccattgctcacatcagtggttttctaactgagggtttcaacccaacggattgtaaaatttaatgggttgctctcagatttttttaataaaaactctttttattgtggcaaaatacacaataacataaaatttaccattttaaccatttttaagtctacagttgaatgtcattaagttcattcacattgctgtgctaccatcaccaccatccatctccaatactttctcatctttccaaactgaaactccatacccattaaaagatgactccccatcccacacccagcccccaggaaccaccattctactttctgtctttatgaatttgacaactctaggtctctcatatcattggaatcatagagtatttgtcctcttgtgcctggctgatttcacttaacacaaggtctccaaggttcatccatgttgtagcacatttcagaacttcctttctttttaaggccaatattccattgtattttttaaggaagtagaatggatttatttatttatttatttatttaatttttaaattttatttatttattttttgagacagagtctcgctctgtcacccaggctggagtgcaatggtgcgatcttggctcactgcaacctccacctcccagtttcaagcaattcttgtgcctcagcctcctgagtagctgggattacaggtgtgtgccaccacacctggctaatttttgtatttttagtagagacagggtttcaccatgttggtcaagctggtctcgaacccctgacctcatgatccaccagcctaggcctcccaaagtgctgggattacaggtatgagccaccgcacatggcaaatggattttttaaatgaagtaaaatagaaaacattagagtacatttctcgtaataaggccaagtattgcttcacaaaatgtttcagttgagtgtgtacataactgtgttcaaggtctccggctataacatatgccatactgtgcttcccaatcataaaagtttgaaaaacactgatgtcagtggttggtgactccaaatctacattactagtctggctcttcccaacgcagttctgggtagctccacgcacgaggatccagacccacagctgtcaccctccccgctccctcccagacacgccatcctcacagggtccctactttcttctcaggaattgggccctgcctgcctcactctgtccccagcaatatagctctaacccctgagtcatgcagattcactcaactcttgcctgcacttgtcaatccttgctcaaactcggtttcatcccccttcctttcacttctgcctatgcctgtggatcattcccctttcttgaagaccccttcaaatgcctccatgtaccttgaaacacagtgattttctctggcgcctcctccttgtttttagagtccctcgtccattcctctaggcgtgcctttctgtcttcccaatagccaccggctccctggagaccctggactgtgcctgccttgcacaccattgtatccctagcacttaaagagtaaatctgcatgaagtatttgttcaatcaatcaaaacagacatggagaagccaagagcatcaaggagtacgttcacaactttgtttcttgtctttttctcctcattcacatagcacatgctttctccattagagacactgagcccactaagccacctgcactgccccaccttctcccctcctgaccaagggaggtgctgcaaatggacccccagagttctgactgctctcaatggggtcctcccaaaagctctggttgcagagcacagggagagcccagggtccaaagaagtaagcacacatcgactcacagccccactgccatttgctctgggctgtcgctaaattctccctggaagagcctgcctttgctgtgtccctgaaatctttgtgaggtggcatcgcaccagctcagcacagaagcaaagaatggcagccttcaggaatcccctggctctgaagtggacctgctccctgcaacaagttcttctcactttcactgggctgtgacagtacctcccagcctctctacctctttaacccttcctgtaggagacccagctaacatccttcttaggggcttttatcctgccattaccctactccagggccaaacacagctcccaatggcccaatgaaccaaatgcaaattgttcttctcaatcttcaaaacactttgctgaggctagtgacccactgttacatctgccctcttcgtcccttccttccacctcacagcagttgtatccatttcttcattgtgtctcttcctgttacaatccctgcgcgcacacacatagtcctaccttcaattatttattcattatccaatatttattgagaacatcttatgtgctggacaccaagtttggtgttcacagtgcagctgggaacaaaacagagcaaattggttgggcgcagtggctcatgcctgtaatcccagcactttggaaggccgaggcgggcggatcacaaggtcaggagatcaagaccatcctggctaacaggctgaaaacccgtctctactaaaaatacaaaaaattagctgggtgtggtggcaggccactgtagtcccagctacttgccaaggctgaggcaggagaatggcctgaacccgggaggcagagtttgcagtgagctgagatcgcgccacggcactccagcctgggtgacacagtgagactccatctcagaaaaaaaaaaaaaagaaagaaaaagaaaaaagagcaaatccccactgcatggagctttcggtctagagcagtttctcaacctcagcactactgacatttggggctggaaaattatttgttgctgggggcaaactatgcattataggtctttacaacctctttggcctcttccctctgcatgcagcagcactctcctctccccagtgtgaatgccacagaagtctccaaacattgccacggggaataggggattgagaaccactggtctagagcagcaggaggagcttgttgcagcttgcagatcgcctggggagcttgttacaaaggcaggttagtagatctcacccgaagacagtcagattcaggggctcaggagtctgcatttcaatggtcctccagttggttctgattcaggccctcccagagcctctgcttgaagaacactggtcaagtgtttgtagacaggagacagactgatgataatcacatcaggccagttcattacaatcatgatatatggaggaaacaagataggtaagcaggtgctaggggtgacactgatgtgacagccacatccagttcaagatcaggactaaccaatgattaagccaagtgctgcagtgtaggtagggtcaggtgtgggagagacgggaggaaattgtgacacacttgcatctctgcacctttgctcctgcccactttttggatgtgcatgccccctgcccccaccctcaaatcttacccttccttcaaggcccactcaagttcaacttcctctgggcacagtcttgcctaacttctccagcctatcagtgcttctcttctcagacagtttaacattcactttctgtttcatttgtggctattttgttgccccaaatagacttcgagtcctctgagtaccaagaccacatcatctccttctttacagacccttatctacaggcacgcttccaggatcagccctatacaagttttgcctggttgattgggttgagtctctagagtgaggcctgcaagatagcatctatgcgattcagggggtcagggtctctgtgagggaggaagggaagcaccttgtgtgcctgctgaactcctggcagctagcccacccacccaagaccagggaggacttgccagagcaagcaggtagtttggttggcgtttgccatgggcggttgtattttccccctgttgacaaggcagaaggaatcccagcagccccagcaactttggggaggtgccgggagggggcaggaacccagagctgccctgctgaagagcaagtgccaagacagcagcaggcaatcggcctgcagggccgcagcaagctgtgggggacccagctgtccttgcataggatcatctcaggggcagcagtagccaaaacaagaggcaggcccaatcagatccaagaagccaggagactccgaagatggcctttaaagccaccagtgtcagacagcactcaggagctgccaccaaccagggaacgctccctgggaaggtccggagcagcaactggctgtaaacaaatgttcagaacaaggtgcctcattactccccagctccgggggagttacaaggaggggaaacagcctaagtgctcggcttttccactggacagcgacacctagcagcgatcctcaccctcccaccttcgtgggcagcccagattgggagcacccatacctgatgtatccacctcacccaaaggatgagaagagggctgtttcgttatggggaagtttagagaagaaggtgggatgcttacttagctagagagacatttattttcctatcaacctaggggaggggcggtgagagtagggagacactagcagcaaactaaaaaacagcccagcagctaggagagagggctcttgccaagagaggctctgatatgggtgtatcctagagcaagaacctcccctaatctctcaaaccaggcggaggaaccccaagtgtttccttaagccagcagagccggcagaaggaagtggctggcatttcagtgtatcttctgcaaatagagaggctgaggctgtgcccgaattgaatttctgagtgacacctcctactgctctttctcttggagtttaaccgtggattggggtggagtagggggagagcccaacgaggggttaacttatgctgcagctctgaccttttgcgctaaggatgagaaaaaaaaagccatctgtttcagaaggaatcaggttgttgagtttcacagatccagtggctgtgggattgtaagacttcactatcactatccctgtcgcatagccacagcccacactaccacccccaccgaacccgaagctcctggaggggaaaatgctttttctcccaagggtccttacgaaagttcaggactcgcgaggttataaacaaacaaacaaacaaacaaacaatcgatacgattttgagccctccgaccccggagtccaaacaaatggccatagaactgtgggtctggaggacaccgctccgatccatgcggtctctccgggtattaaatggatttatcgtcagcctggttgcttggaattctattctgtccttcatttttcacagcggaacaaagttgtctggaccctccagccagcgctgggcagaagcaagcaaggatgctcttggaaacgcggtggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggccgaggggtccgcgtagcgcatcctggctaccgggcgccgcgggcgcggggtacggggcggccaggcaatgactcgcggggttccggggccccggggggcgcgcggccgacttggcgcctcacggtgcggtcaggcaggcgggggacttcgaggggcaaagtttctggttggcgcggccggagctgggggcatccaagcgtcgcaggcgctggggcggcaagcaggacagggccggtggcagggagctctgccgcggccaggggccttccccacccccgggtacctttacctccaggcgccggtgccgggtagccgccgatttccccgcggaggggagacgccaggtgccacgagccggaggcggcccctcccgccgaggtggcggccaatggggagcaagacccgggctccgtcccctgtgcgccccagcgcgccgcgcatcgacccctccagtccggcgccggatcgcggttgcccagcgcgctgtgccctgccgggggcgggccacgtttgatctccgggcccgcagcaagggatcgcgaaggttggcctccggttctgccgatagggacggggggagggggcgtac

SEQ ID NO: 392 - DNA, 107474 bp, Homo sapiens
  source 1..107474: mol_type = genomic DNA
tttcaagatgataaacttcaaagtgtattttttaaaatgcaagttgcctgtatgaaataaattaaaaatttatatgtaatttcagtgtaaaacaccaaaaccgaacattaaaactgttcacagaaaatagaaaaaaaaacaaaaaaacaaatcacaattataaaagcacagagatatcagttataagaaccaagtaaataaactaatttctattaatattttcatttactttataaaactttgttgattaaattgggggagtctctgacaatctaaagggtaacaaaataacaaatatacatcatttctttataagtcataccacacaaaccaagttaagttttttctatctgattacagagtcaataaatattgcatctgtatttagagcagcaacataaaactttattagaaagaaatactatatctggaccaaaaaactgcaacatggtttggaaatctaatgactaagaaggtaaaactggcaactatgtgcaactactgctcgtagatttgggtttgtttcccccccaacatctttaaaataagcagcccccacaaagggataatccattgaataaggagacaatgtagccaaagaagggatttgtggaaaaccatatgaatttaaatcaacataaaaagaacacacaaaggccatggaaacttgagaaggtgaaagaaaaaaaaaaaaaaccccaagcaaggacaagtcagctccttggagctgcaccaactcttaagtaggatgtccctattctaacggaaattgatgagtccacacctgggcacttcagtttgagaaatcaattggttggactggccattaaaaaaaggactttgtttttaaggtagataaagcttagagagagaaagctaaacagaaaagtaccaaatccttgtgaactcaaaaatgatttaggaagtcaaatgaagcaaactaaaaaactggatgaaaatgtttctctaagagtaaaacccagttttctctgtgatttaaaatcaaacaaacacactatagaagagaaattttcaaagtgcacccaataaaacctcagaggttccctggagtgtttggggtagcatggattgagacaggaagtgggttcaggcccatctcccccaacccttcttcactttaattcaaacatttctaattctcttttgtcgtttgtagtttcaggtaagatatcattttaaaaaaatgaaaaaaaaaaaaaatctaatgctgtccctttccctaagtttgaaaatcactgctgagactgaaattacattggtgagaaatatgatcatcataaatctaaaacacattttctatgtagtgctaccaaaatacaaagtttcatcaaatatttcactactattctgtaaaataaatgagaaaattaagttgttgggaagaaattaaattttgttattaccacctcccaaaatctgctcttctgctggctccaagatatcaatatttgatagtgtgaacaaatttctaacaaacattccagtcacaccgtaccccaaagacatttcattcaatggctgcatagtttcttttttgagaaggcaagcctcaaatttatagaaaactctagaatgaaaaatgtacaattactaaaaacataataacacactttatgtcagggcagaatctgcatagtgcttttaaacataatcaccaatgaagagtagccaaatcccagaacttcacacagcactcattagcaaacaacgtcaaagtgtaaatgataagcaggaaaaaaaccaagtaacacgaatgccatttttctttgatgcaatcacgaagaaaagtggaaatgcaggacgaaaagtggaatccaagctttggccacgtactgaaacttcattacttcaatgaaacagagcaaatctccatggaaaggactcattcagcaaacattaagttctttccatatattttttttccttcacgtaaggttaaacagaagttgctgtcattctagaatcagtgattacaattttttttttaattagaaaaaaggttacttgaatatttacataattttattgctctttattttaacaaaaacttttttcactgatttgtagactccatccattaacgtatgaaagtgaaatccatctctcaggaagatacagttatggttgaatgtatctgatgctgagagtacagcataattaagaaaaatccttgcatgtcatttggttcttgttgcagtcttctgtgttcacccctcagaaagcaaaagaatccatctgactttcaataaataccaaattattaaaaaaaaaaaaaaaagaacgtttccacagactagagatccaagaaaaagcagttctgatgaatgattcccagaatcaagtgagtcctcctttagtccaatgagatgatgtcaggaatgttacttccactgctggttatgacccctgtctcactcctgctgctggatgaactaacatgagtactgctttcatgggagctggtggtggtgacagacgtactgcttgctgttaagggtgaggtgagactatccaaaaacataggaggacagtactgcttgaaacaaacaatgatgccaatgaggaagaggctacttgattttaaataaagagactagaaattattagatatgcacaagcaatagtcacatatttaaatcccagtgggatttaaaaattgctcaaaacttcacatctttgggtggaagatagcatgaatttagctattttacattatttagagaatgcagcatatattcttgattctctctaaacttgtggaacttgtttgctgaccacatacaaaggtaaaagtacaatgtcaacaataactgaagtcatttaatactaaatattggccctaatctcaaaaagaatttgctccctaactgtatttagttgggtgtcaattttgaaagaattgttgatcttacaccagcatttttgcttaataacatttttaaaagtatttgttagcctttcccggtatggattgagtatcaaacagatcctttatgaatgttaaggctgaccagctgaatgatggcattggactcctttgtacataaacgtaaaatacttgtgtcatcagaatgacaacattcattctaaaacacagactacacggtagctagctatcacaggatcctcaggacagaaaattatctcaggtaatcaccaagttttgcaataaatgttaaagaagatctaacctaatcttctcgtgatgcctgcttaacacccctttcctagtgctcatatttcacaagtccccttacaatcctggttactgatcccattactgatcccaaacaagtacaaacctgaatgtactactctaatattaacagaggagtgaagagagacaagccaaaagcattatatcagtatagaatatttttatgtgagaaacgactgcactgactttagtaaaacaagaggtctagtgatatcctgcaagagatggtttaagtttgtcattagttcaactgtatgaaagatcagtaaggatatctgattcatattccccattctaaagattatgcagcttatcattagagacactggattatggaacaggaatttaagtcaagttgtttagactacatgatttccaaggccggtgaataaaacaggaacaacagtcccaggtttaagttgccagccagagggacagcaacaagtaaaattcagactgctcttcaaaagaacaagttatttaatgctttggatagataactgttttggttcatcaataaaatgaatgccacatacagagtcaagggacattagttacagggagaacagttcttaaagagcttccaaggagctctaaagatggttgaattgtccagtattaaaactcttttctaaaatcaaatcaatttctaactttccactaaaactggggggtaaatctagaacaaagcccagaaacttacattttattcctgctgcctctcaggtagtttttgattgccttataggaaaaagatactcattcatgaaagttgtgctagatgctacagtgctgccatcaacaggctctgtgcgttgaattcttagtagtattcagattgcagccacttaagttctaaccctgcatccctaattgtagctacaatgacaagaattaagggataatatggaggtcaagtagtaaaacctaaggattctatggcaaactgaaggccccacatcacccttctactactgactcaccaaataacttagaccactactaaatatacaaaacagagctatgaaataaaaacctctaggttccaagataattttttttaaaagaactggtcacataaaaattagtaatcctcacatctgaagaatccatttcctagaaaaatacatagacactttcactaggtaccttcgttatatatactgctgtaatgaggtcaactccgaatgataagaaattcctcagtctgcacattaccttgggcccaaatttctgctgctgttcatgtaatcagatacagagtactgaaacaggaggctgatacaggacttgtgcttagctgactgagcagcccatgaagcagtgacccgtggttcttcctctatccctccctatactcaactcctctcaaagtcttttgttctatgtcattttctcccttcacttttctcatgccttctcctcctctgctctgcctctgctataagcctgtctgtgcaatccaggctcactgcaaggtcttcatgttgggacaccgagctactagggtttctcatctttgacagagaaaacggggatgattgacatatagcaactttaaactggggcctccccaaagtccaaatctgaatgtctttaaaaacaatgaagaatcaagttaatgagtcaagtctgtctaatcaggtttagctattgattttctatatacagaatgttttagctaaaaaataaaactgtatttgtaaaattttaacttctagccacccagcactgcttctattcattctaatcattcaaatgcttgtaggagatgccaactgattaagctaaataaaacagaatttaaaatttagatattaaagacaaaaatcataaactgaaaacaactttattccttcaaataaaattgtgaaatatttgcacagtacttcctttccatcaatgtaagtaattcagagatgactgtcctgattttatgcaactggtcatttttagttagtatgacataaccaacaatcaaatacaaattagttgcttaaattcaggatacatacctggggatcaactggaataagggaaagaaaatccaaacctaaaacaaaaatgctttgttaatagttgtctcatattttgggagaccagaattatttccctaaatcatctttatcacaaatcacaaaacatttgtggtaagtgcttaccactctgtcacagagaagttctataccatgatcagtgatatttgaagtgtttaaaacccaaagatgaatatattctctgataaaacaactggaaaaactagctcccagagactcaaatgcagaagtccaaaactttccagtgaaggactagtcaaaacaaatatttccccctttgccgcttaacagaatgagaagcaataaaaatgatgagctaatgatctggatttgaaccatctaaaaaaaaaaacatacttaagctcttaagatatttcacatttatttttcagaaatacagaggttcatctaagtatcgcttcttaaacagatgtctatttcaatgacagctctctgtccccgctgtccccacatcaagagcagtacatagtccaacgctctgcacaaagcacacactcgggaattgctgcgctaacagggttatcaagggttactgggttctgagctaatgtaattttctgaaccagagaactgtaattgtccaattcgattttagaaagaggaatgtgtaaaaggttgtccagtaatatacttttgacatattcaagtaataacaataaataaaatttttaggtctgaaaagtctagtaataaacttcaacatcagttcacctagacctccctgtgtgactaaactctctttaattatttcaaaacattaaaaaagaaaccataggtcattaagacaggccaatttctattcaattccgtgaatttttatgctggcattcagagacaccccgaatataaccaccacacagagaaagtctgacattatgcttttatgcaaaatagagaatatcagtgggtacatttaaaatatctactaaccagtatgaatttataactcaaaaaatttaagtatatttattctcttataatctccaaataagggtattacaaaaatgcttatcaagtgatacaagctatagcaccaatcatttgaaagaaatcattccaacgatttctaaagcctttttgaaaattgttgctacagattttttttttttcctttttttgggagacactgagtctgctctgttgcccaggctggagtgcagaggcacaatcataggtaactgtagcctttaccttctggcctcagcttcgcaagaagcaggagctacaggtgtgtgtcactatgcccagctaattattattattattttttttttgtagagagagggtctcgctatgttgcctaggttggttttgaactccagagctcaagtgatcctcccgcctcagcctcccaaagtgctgggattacagacataagccaccgcacccagcttgctgtaatttttcatttcatatgtctgtcactagctatatgacacagtggtttgagccaatactaaaccaaagagaattacaacaaacttttccaatgacttctctattaaaatgataataggtgagatatctcaataagcagattttgtcttcatattaataatattcaataaatcctctcccttcttatgccaaacaattcaaaatttgtctagcccttgtaataccttcagagttttgcattttcaatatttctattattaagtaaaaaaagtttattggaacattttgttctgcttcaaatggtataaccgttttctttttacagtaacttcttatcttttcagtttttcagttttcttcatttttacaatagcttctacctttttatagtttttcagtttcatatgttcaatcatctttaatatttgctgtatctctcagttcatgttagtaactgaaacctttttataacgctaagtattgacaatggtgttggaatattgtgtactgaagccaagccactcaaaaatgctcattttctaaatgttcaactatttcaatttcagaatttcaattaaaatacgcaagcttgatataaaacagtttgaaaattatatcaagcctatttattttaattgaaattaaaaattgaagctctatcaccagagaatacccactgaggatcctatttttgttatttcaattccagttcttcagatgtactgtaattctctttgatgatttcatgtgtgtggtaaatataaagtttatttagaaaacaattaagagatttacttatctgtatattgatacctcatccacggaaaattgaatgtggtgacttatacaacaccataataaaatacctagaaatttttctaaaatattggttggaattctagattgtttaccaagcattacaagggtgctgtctatataaaacctgtttaatgtaaatatttctctcactgaaaccatttttttctcaagtactaacagtgaagtttgatatggtattttagatgttattctttctaacaaaaaacgaaaccatcaaagtcttcttgcattttacattttaagcagaatattaaaactcttatataaaatcaagtttcatcagtagtgattaaaattttactgccttgtttcgtaagtttagcaaaatgctgtttcttatttcaccataagtttcaactgcagcgtgtcatactgatatatttttatgccctccgaagtatttcatggttgaaaatgctcaattacttttaactaaaaagcaggtagtgttaacattattttattaacactgataaaattttaatttaaaaattttaagtgcttcactgtgaaattgactcattagattttttctcattgatgacaacacattttccttatttgagtcataaacttttaacaaaacataactgctacatgattaaatatgtaaatgtttagcactttcaaattttaatgatacaacttttgagcaccattcgcacctgacaatatggcactagcaataataaggcagtcatatttttccttgaaataagctgttttccactccataaatacaaattatttgttttattttgtattcactgttgcacagtatcagaagatgttccaagcttcagttcattattaatatcatttcttctttgttctcctgcagattcagaagattcatgtttatgatgtttaaaaggaatgttaagaaatgtattaaaactttgttatctctccattcttggtgttctatttaatattttattataaattattaagtttatcaataccaaaactcttcacagtatgactaactacataaaaattatgcataaaaataaaaccaaattactaatcacaaaagagcacattaacaataaaatcaaagtaaaactaaactatttagatatagtaactgctacataattcatacatgatgataaactagcaattcttctaaagcaaaatagatcctattctattcagttatcaactggtaagaaagcttttcaataataacaaccagtatcaccataactgttaatactggctaaatatcagccttggatattagtcttgtttgctcaatatcagcttgaaacacatttttaccaaatagccagttcagacatattttactgcatttttctcaagtttgcacatttctaaaaagaaataaagtctcactttatgcccaaattctgaaataatgtaaatttcccccaattaaaaattaatccaggttcagagaactgaaaaactaacagggcaagtgattggtaaattgtgtctatgctactgctaaatggtaggatcactttaatgaacagaaatgctcattaccttttttcaggattaatttttaattcaaggtctttaggaaacaaatcctttcagaatgcttgcttataacacatactgagatgacatgcagacactcttccaacaacccatgttacagccataaaaggcagttgggaattaagaatctctgaatttccatctttgtcaccgacatgaatcctcacctgtaccttggcattagactttgtatatactttacaaatactttacaatttgtgctagctgggtctacaaagaacttcttaaaataccaactcccaaattacatgtggagtaactatatctaagaagcaaagaataactttaaaagccatttttttctatggatactataaaatgtctattcttttccactaaattttattcacataatctaaacaaatttcaagtggcaaaattataccgagccaattatcaattgtttcagtaacataaactttcaccaacaggataagcattgtgcttaaaataaagacctcactaaggggagaaaaaaaataaatcataggtcaaaattaacttcataaacctagagaagaaaactagtaacaggaggagagaattgtattccactaaaagggccttcggagagaagggaagtcatgaatgtactggttctaacttgctcaaatataattgacagaaatgtctgcaaaagcaatagctatggagagggaagaagagtaaaggagggaagtttaaattttgtaatatggccttggttgcagaagtcctgatactaaggtaattctagcaaccttaatattttacagtagattcccccttatccaagattttgcgttctgtgattgcagttacctgtggtcaactgcagtcagaaaatatcacatggaaaattccagaaataattcataagttttaaattacacactattctgaatagtctgatgaaatctcatgctgtcctggctccatcatgctccatcccacccaggacatgaaccattcttttgtccagtggctcccagctttgtcactcagtagccatttaagttaacagattaactatctcagtacacagtgcttctgttcaagtaaccgttattttaacttaataatggcaccaaagtgatgccagcatattgttataattgttctattttattattagttattgctgttcatctcttactatgcctaatttaaaaattcaactttatcatgagtatatctgtatagaaaagaacagtatatagggttctgtaatatctgtggtttcagacatttactgggggtcctggaacttatcccccgtggataaggggaaagtactgtacatataaaagatatcccaagtattaagccccactctagggaaacagatggtagactctatctttgtaaggagaataaaatccacagcttgtaggaaaaatcagccccaaacaacatcaatatattctgaagttctgatgagctaccaagaagagtatgagaaaatattctcccttcacctgtgaggttctataataaagaaaccaagaagaagtctctaagtacaaattcttcaaaaggaagaataaaatctctaacatttcctattctactatatttcttatcaccaggaatctatagattgctctgtagttaaaataacaactggatgtgatgtataaaaacagataagacctttacccgaagctttcaaatttccttagcacctctactgaaaatttcaaaactatactggcttcacagattaagattaaaaaaaataaactttcattaaaaaacaaaagaaacaaaaacactccacatacctggcaaatctgatgacatgcttgatattggcgtatggtggaatggtactgagtagtctgttaatgaaggcggaatagcagcaggatcaaccgaagtcacactgggcacccttacagaagatggctgatacatgagaaccctgttttaaatagcacgggaaattacaaacaatctggctgttagttcacaggagagaagagctgcaccactgggcattctcagtcgttcgttcaccagtttcagcacaactatatggcagctactcactacacagcactccactctactctcctctcccataatagtcttcattttaacatgaacatatcttggctctcaacagcagctgcgacataagagcaagttgacattcaaacacaatgtacagtgctggagtgagatataacacttccatccacaaatagaaatagacatcacttttattaatatgtatgtaatatgtatatgggtatcagtaattttatctataaagaaatttaaaactaacatagaagatccctaaggtttgatttaaatcagggaaccttgagaagtgaagctactcactgtagcacaatccaaatttcttcaagtctaactcgaattgtattaattatttgcaatctttcctgggaatcatctgagcaaaattacccaatcttaaagccgaccaacttgatggcaataggccacaatcagaaacgaggatgagtgttcaggatttaaaatataatatccagaaataaaaatgctggctaccatgatagcacctaccaggtaggtgaaatcctaagagagtttatgattttaaaattagctgttcatgctaccaaaaatacaaattaaacatatgtaataaatacttcacaattggtattatataaaactgtatatacactatagaattactttataatttcaagaagcagtataattaaacatacttttgaaaaagttcaagcttaaacagagattttttttgcattcttcctatttaacctgcattttctcttagcccagggtaaacaactacaacttcacaagaaagacatccttgaatgtatgtaggaaactgagcactgttactggtcttatggttgatggtgggaaccatggtcacaaagctagactgggataacctctgggcatcctttccctttcctgttattgctgattattaaatatcagtaatgagaaatgatgacaaattgcatgacattctttgtactctggaaaactatttcataacctcaatttaaatgtcaaaccacttaaatatggatatcaatacaaatgtggaaaacagtcatcttgagagtacatacattgttgagttggcaactatgttagtctcagaaaagtgaataaataacacaggtcagagttcagaaatctttgatcaaaaactgatccatttaggaagcttatgacatataatatgcttgaggcaataacataagcctggtatttgaaaatacattttcccgaggtagataaagacagaaggaagttatcttccaaaaatcaaccacatgtctgtaggttagaatctggagatttcttggcctccagtgctactcgaagacctaaaaccacaagcagtatgtgagcaatgttagaaaaggcagactctggaggaaaaagagaagttgggaggagataaaataagttatattgtatctaaagctcatcttttctggaggtttgaaaacagtggtcctccacagggatcaaacgaacaggacatcatcaaaagtttttcaaataacatgagaccacctctcacacacaagagtttatatgagaaactggaggaaggacacagtgggtaaggaggagagagagactggggtatacgtgagtgctggggaggggactaaagaagtggtctgattattctggctgtctcaaagtattaatatcttattgttttaaaaatgttaacaggcaggcttttgaagaccaaatatatatataaagtttcatttaatttaaaaagtttctacttaagagtacatttagagccaggcaaggtggttcacacctgtaatctcaggtctttgggaggccaaggcaggaggattgcttgagctggaagtttgagaccagactacggaacatagggagaccttgtatctacaaaaaaaaaaaaaaagccacatatgctgaagtatgcctaaggtcctagctacttgggaggctgaggctgagactgcttgagtccaggaggtagaggctgcagtgagccatgaatgctccactgcactctagcctagacaacaaagcaagacctcgtctcaaaaaaaagtacatttaacctatcgtgttttttttttctctgccactgaaagaaactaaaagactttctggtacaagaaaaagctaatgaatgtctttttcccactcccccttctcttcctttgctatttcacactggagattttcttttgttttgatcctgattgccctttcaacttgaaatagacttacacgtaacaacaataacagagctccctttccttccctgaccctttgacttacatctataaaaggagtcaagtgaatgtacctacacacctgtctgtcactacagtaacacctaataactgtacgtgtcctgtcacttagtaacatgaaactttaaatgagtaaatagctactccttacttaggcaacaccaaaaggttgactgtcaaaacatgtgaaatgtgaaaatccaatggcggtacaaattagtaaatcaacatctaaaacctcagcaaacatatgaaaagctaaactacttagtgttggttaattcccattacctgaatgttgcaaccattaatacaaattcaactttacatagaatggcttaaagtagtcattagttaggattatcaaattacatactgggagcaggcttttgttatcaaaatcttcacaaagaccacattcagaaacaaaatgattctaaagcctatgcaaaaaatagatatgagtaacagattccatgaaaaaatgtaaatggctatggatggtgaaatgatggatgtaaaaatgtgatgctatatgttaataaaaagatttaaagcttttaaaacttgttactgcctcttcataggattggtaaacacacacagatacgtgtatacattatgcaagtgaccatttatattttaaacgtttgtaactttatccataatatcacagcacaaaagtgaattgctagaatgctgctatatagcaaatattagtattccggattatatgctggatcagagaattgcatgaaactcacatttgctcagacttggatgtctgaaaataggttgaccatttctatttataaccctgaagttcactgtatgctcccactttatgatcataaaagtataaaaaagatgcaattttgctaccaattcttaatgattatcaatctggagacatatagatttatccttattatgtttcctgtctttagaataccttcttattaaggcaaagcaaccactcatttttcagaaggggcacaatatgtaaaattatcttttaatatggaaaaacatcagaggttttctaaatgtcttaagattaacatacaagtttcttctgacaggtattataagactgcatttaaagactccggttcgtaagcaaagaaagggaataggactgccatcaaaatggcaatgattctctctaggtgagatattttttgctttcttcttggtgctttgtaaaattgtttataagaataatttttactaaaataataatacctcttaaaagatagttgctcacaggccaggcgtggtggcttatgcattttgtaatcctagcactttggcaggccaagacaggtggatggcttgagctcaggagttcgagaccagcctgtgcaacatggtaaaaccccatgtttacaaaaaaaaaaaaaacacaaaaaaattagctgggggtggtagttccagctacttggagggctgaggcaggaggatcgcttcaacccaggaggtcaagactgcagtgagccgcgatcacaccacggcattctagcctgggtcacaaactgagaccctgtctcaaaaaattaaaaaaaaaaaaaaatagttgctcacataatttcggggctgtaaattagagtaagttttcctgatttctcattctctgttctttctcatttgcttactatctttgatggccaagaaatcctatgataaacttacacagcacaggaaaaccataaaaactctagatgctgaactacaagaaaggatatgaaaaggacaaccaagaacaaagtcacaaaagtctaagagtaggaggggatcacagagatgatataactatagcatgagcctccactatgacactgtgacaggtggcagccactctaacacagaaaatatgattttgggacaaaagattaaatttcctagtattcagaaagctccaatagaaagtttatccatgtatctttagtccactggacctaaatctggtaataaagaacaaacttaatccagctagtcattgtctcccttttaagaactacaaggtgggtatcaaataatctcttctcctggtttaacagcttcagtccttaagatccactcatccatcttgctccagattccactattcaccttcccgttcccctgctctggccatactcatttgttaataccattcttgatgatcagcactgactgaaatgctctgagagtcatatagcctaaaatggaacaaaactggcatggtatggatcctggacactatgcttattttattaatgctaagaacaaactgatttcagtggtgaactcttcaaaccattaactgaaacctgacatttgaaagagtttctatcagaaatggcaattaatttactgaaggcctttccaacatccatgaagatgactacaaagttgtccttatgacgagatccatcttatcaatgtatttcctaatattaaagcactcctgggataaactctagttggtcacagatgtcattttaatatataattaaatgatttcctaagactgaattcagaattttcatttatctttctatgtgagtctgtttcttaagagttcttccgtgtattaatgtgtatgtatgtctaggttgggtgttaagggctacatcagcttcatggaacgaactaggtagctgcgctttatacagacttttaaaataaactttcatgtgttgctggtttagtcacaaatttctatcttatacttaccaatgttagtttttgttttcttttcagcctaaatgaggaaccttaacatttatctctatagtagctgatcacagatgtaaactatccttattcctctgcatactgaggtcatttcagattttgtcgcccactgtgtatgtgccatccctcctgtttcatggacttatcaaacacagataaaaatgtagtaaaggacagagggtagacccttgtggcatgccaccagagacatgctccaagatcacaacaactcatgagtcagcatcactaggcatgacctctcaacctggcatgaattcagccaactgcagtacttgcaactcatgtttttccactatattctaaagcgtatcattacagagtaaaatccagaaacatcacatctaagcattcattccccttcaaaatacattttgaacgtaaccatttcaaaattataacttcattttctgtttatcatttaaattacagatgtaccaaccaatttgtctcaaaggagcaataaatgattggcacaccaggaaaaaatccacttgaaatacttcctcattttgttccacacacacaaaaaccccacctcattctaattaaatgggtagaagtaaatatatgcctttaatatatgtgtaaattatatttggaaatgtaagtattttaacagcaaagaaggcagctgaaaaggtttaattcttaaaattataaaaataaacaatgttgcaaaacaagacattttatataaaatgtctaaacaggcattatagacacaaaaaaacgattgcctagatttggggtgtaaataggaataaactacaaaagaacatgaagaaagttttttgggtgttgaaaatattctactactgaatcatggtgatgattgcacagctctatgtatttactaaaatcactgaattgtgccattatatacttaagatgggtacattttatgctatgtaaattataactcagtaaagccattagaaaaccaagtggaccaagaggccaaaaagatgacactagcaaacccaagtttgaaagaatgtgttcgtagacagccaggagaactctcctgttatctccttttatggttcaaaacctctctgaaaaagcaactattgttaaatacccaaacctgatttttaatgcaggtcagtaatgccttctgccagataacttacagagaatccacgctaaaattcaggtagaatgccatcctacccacctatattttgccctggagagggtgaaaagggaaaggaatcaatttttattgggaaattaccacatgcctgacaccgaggctttctttcatctcattaaaacctgaaaatgatcctgtaatataggcgttatttagctccatttaacagaacacaaaaaagaggctcaatcaaattaagtatttcatctaagatcacagaacaagtaagcgatggtgtgccaaaattggaatccatacttgtcagattcccagttccacactccattacaccagactttctcatctggtctgagatgccaaatttccttacaaacaggttcaagaaaataacaaaaagtctcaggtaggaaataaatacctcacacgctcactttccaaagatgtaaatattttctccatcaaaatttgcttcctataaacaatgtgcttactcgaaaatatttcaactcaacaaaggcaaattaaaatagccttctacagttatgccatttcccaaagagacatttataaatctatccaagagcaattagttgcaagggtaatgaacaatagtgaactataaattaacaaaccctttggttgggctgctttgtgtttctgacataaagatgcatttccttttggcaggagggtcttcctcttcgtcagaagagctttctattgtaagatcaataacatctactttcttcttgcttgcctcactggctacagtcactgaacaaggcttactgaggacgcttgaacctgcatgtaaagaaacaaaaggaaaaaaaaattaaaggtataacacaaataaactctagtggtagagtctagtatattcagtatagtatgttcctgacaacatatagccagtgaagccacatactccaacccatggacaaataccaactccctaactccagacctctgtctgtaaaatggttgttcacctagggagacaggtgagcactattccttgacagatggttagaagtctcattcagacagaatgttcttagttatgcctccaataccactgaaggatttgtgcagctcctactgctcatcctgtctctgcaggtcagcagtcgttttacagaaagacacgcagagttagggaactggtctcaggtcatgggacaagaatgggtgagttcaacagctatgtattctcgcacacatgtggcacagttagctcagaaccagatatttccattctagcaattatgcttatatcaaagaaagtacagacttttcaccataagccagaacttgataaaaactttcatcttgataagttgaaaaaaacccaaacctctcaattaagttactaagacatttaaacttttcttatgaattatctgctaatcacgtaggttctttctacccacaaagacagtctcacataccatatttgttaactcacattttcacagaaaagtatgttattatctgtaatgtatttagttaaaaatgaatgacagttgataatggaaaagcaacagaaacttatcaactaaatcactccccatttttctgaaagatgagagaaaccttggtcactgcactcaggtttagtgtcaatcgcagaggaataattaataatggcataaatcctttattttttcccctttcttcttactccattcattacattgtttgttagaacttcaaatgtaatcagaacaaaactgaaatgcagtgagtagactgttagataaaaagaaactctaagttcacgtgtgggtttcaatgagactgttagataaaaagaaactctaagttcacctgtgcgtttcaattactccaaatgccctcagtttccctacttagtgtggatggatgcaggcagttgatggatgagtatacattctaggtaatcaaggcaatgttaaaattcttctccacaaagaaatggaaggtaacaatttgtttactttctgagcaactaacctgtgaccatccccaaaccaccaaggccattaaccaatgatgcagcctctctaacctcacctccacctagggttccacctacagatactctaagaacaattctgaaaaactgtccatataaattcatttgtgactttttgttttgtaacaaacatcatattttaaaatgattttagatgaatgtttcctttattctacacaggaaaaatatactatgaaatagctgataagatggtataaactttagcacattccttcaggaaagaataaaaatcatttgggggaaaactatatatcatcaaaagactgagtcaacaagctgaattccaaacgtatagttctaggggccaagattaatgataatgttgcacgagtctcactgctttactctctgctgctattctacacatactttctatttttgtacacggttggctggatactttcatagcttctttcttcggtctcattggacaccaagaaccatcttcttggaatttgatctcatctacatcagaacagtcattgagaatttccataaaaagcctaaaaaacaattaagaagtacatacatgtgatcaacagctttgcctaaaggtgaaataagaaagtaatacacattaccttgaaaacataagtaatgttagctgacccccttttcttttggtattgcaatactttatactttacaacaattattacactccctttgtcctatgttttaaatctgtaacaggcaacataatagttaagtaacttactgagcatcacctgtgtaactcaatgagtataaatggctagagagaagtagatacctggagcctcctagctgaggctggcagtaagaacaacctctaacacagcacaaaaaacaaacatcagcagataaaggttactatatagtaaaataatttataaactttaacttcgagaaaaaaggataatggggtaggggaaggagggaagaaaagggaaataaaagaagtctcaataaatttaaaataagtgtatttgaattaagttcaaattaagtccgtaccagaaaaacctgaaaacttggaaactaaacaaaagaaacatgagtcaaagataaaaataagattttaaactgaatgaaaataaaaatgtaataaaatttgtggactgtattatttaaacactgaagtagtatttaaaggaaaatttatagcattaatcttccctaattagaaataaagtctcaaatcagtaactttatgaaactagaaaaaaaagcaaattatagtaaaagcaagaaaagagaaataacaaagaacaaaacaaacaaatagaaaaaaagaaaaacagaaaaatcagtttctagtcaaacttatttacactcactccaaaagaaacagataatctaagaagccctatgtctattaaataagttggatctgtagttaaaaactttgccacaaagaaaatcctaggcccaatgtcttctctagggaattctaccaaatatttgaggagaaataataccactacttccaactcattgtacaaggtcagcattactctgataataaaaccaggcaggcattgcaacaaaactaaatacccaacattcccccatgaactctgcaaaacaaatccaacaacaaatatacacaggataacaaatcatgaccaaatggggttcattcccacaatacaagattagtttaatatccaaaagtcaatcaacataattcaccgtattaccagactagtcaatgcaaggcggtgggaaaacaaaaggcatccacgttagaaagaagaagtaaaactgtctctatttaaaaaacattactgactatatagaaaatcctatgtaatctataataaagctactagaactactaagggatgggaataacatatgttgatatgacagcaatatacaaaggtcaactatatttctatatattagccataatcacaaaaattttttaaataccacagagatatgaaatatttaggaataaacttgacaagagatgtacaagacacattgaaaactacaaaacactgttgagacaaataaacagaaagatacatcctgttcataaatcagaagactcaatactcttatgtcaccacagacttatctacagagtcaatgaaaaacaaatcaaaatcccagcaggttttttcccctaattgacaagctgattccaaaatctgtatgaaaatgcaaagaatctacaatagccaagataattttgaaaaagaagaacaaagttggaagagtcacactacctgacttccagcaaatgcagtattgacataactacagacaaataaatcaatagaacagttcagagatcacacatatagtcaattaatttttgtaaaaggtgcaaaagcaattcaatgaggaaaaacaaatcttaacaaatgatggtgcagcaatcacatggccatataccaaacaaaaacaaaacccttgttctttatcttacaccatacataaaaattaacttgatagaaataataaacctaagtgtaaaagtaaattataaaacttctacaggaagctcagaaaaaatatttgtgaccttgagttagggaaaatgtcttaaaataataccaaaagcacaatctttcataaaagaaaaacttggtaaaccagccttcattcaaagtagacacttctgctttttgacatacactgttaaaagactgaaaagataaaatgatagaaaacatttaaaaatcatatacctggtaagacgtttgtatccagaatacataagaaccaccaacattcaatgacatgaaaacaaaacccaactaaaaagtgggcaaaaggccaggcacggtggctcatgcctgtaatcccagcactttgggatgctgaggcgggtggatcacgaggtcgggagttcgagaccagcctgaccaacatggtgaaaccctgtctctactaaaaatacaaaaattagccaggcgtggtggcgcacacctgtagtcccagctacttgggaggctgaggcaggagaattgcttgaacccaggaggtggaaggttgcgctgagctgagatcatgccactgcactccagcctgggcgacagagcgaaactccatctcaaaacaaacaaacaaacaaacaaacaaaaaaaagtgggcaaaagtttggtcacttcaccaaagaaacgtacagatggagaataaatacgcaaaaagatgctcaaaacaattagtaataaggaaaatgcaaataaacccacaatggagtaccactatataccactagtatgatctaaaattaaaaagattaactggccggatgtggtgactcatgcctgtaatcccagcactttgggaggctgaggtgggtggatcacctgaggtcaggagttggagaccagcctggccactatggcgaaaccccatctctactaaagacacaaaaaattagccaagcgtggtggtgggtgcctgtaatcccagctactggggaggctgaggcaggagaatcacttgaacctggggggtgggggctgcagtgagccaagatggtgccattgcactccagcctgggcaacagagcaagcctctgtctccaaaaaaaaaaaaaaaaagagaagccataccaaatgttaatgagaatgaggagcaatcaaaactctccatatactgctggtggaaatataaaatagtacaaccgctttggaaaacagtttgacagtttcttgcagttaagcacacacctggcatgtgaccaggcattctactcctaagtatttacccaagataaatgaaaacagtccacacaaagacttgggcatgaatgttcacagtagctgtatttccaacagccccaaaacagaaaaaacccatcaacgcatgaaatgacaaactgtgggttagaatgcaactcagcaataaaaatgaactattggtatatgcaacataaatgtatctcaaacaagtatgttgagtaaaagaagttagacaaaggaagcacatagtttatgattccattcatataaaagtctagaaaatccaaactaatctatagaaacagaaagcatatcagtgtttgcttgaggactgagagggagagattgaaaacatacatgagaaaactttaggtgtgatgggtgtgttcattatcttgactgggataatgatttcataggtatataataagtcaaaatttatcaaattgtacattttacatgagtagttcttatgccaaaaatgcctacttcataagaggtttatttttctcaattatactgaaaattcagcataatgtaaatcaaaacccaaaaaggttctgtgtaatttgagaatgcttttattcaagtgaacatggcagaatgtattatgacactagtcaaaaaaattctgaaaagaaatggcctaagaaatactaccacataatagaaatctaataattaaaatagtttcgtattggcccagtaatactttgatcaatggaacaaatagcagttcagaagttaacactagtatttacaagaaatgtattagataatgcaagtagtatctcagatctgtgggagagattattcaagtaaatgtggttgagaataatctgggtgctagggtgacatgatccctaccttaatgggatcacctattccctactgtaaagttccttcctcatccccaattttcctcccacagtgtcattccttaccttcacagcactttacacttaatatacttttttttttttaccatctcccatactagaagtgccctgctcaccatttttagacctagtatctgacacatgataggtatttagtaagtactgtgttgaatgaattcatgaagcaatgtatgacggaacaactgcacaactggaaaaaggaatcacaaatgtgcctgatgaaaacaagcaagtgctcatataaaatctctacaactttctaaacactttcaaggaagacattcaaaaaggaaaagacaagacttgataaaaaaaaatgtaaaccttctgaatggagaacaaaggtcacaataaatacaaataaaagggaaactgggaaaatacatttggcacatgtggacagagaaattaatatcctcaatctataatgactatgtataggccagtaagaaaaagatgagcaagcccatagcaaaatcttttttaaaaaaggaatattaagaggcaatttgtaaaagatattataatgaccaatatatggaattaaagaaatatctgataactcctataatacaaaaattaaaaatcaaaatagctatcttttcaattaggaaattagtagacatttttatttgttgttccattttgttttgtttacttttgaaacagagtctttctccatcacccaggttggagtgcaatggcatgaccattgctcactgcggcctcaaactcctggtctcagacaatcatcctgccttggccttccaaagtgctgggatgacaggtgtgagccaccacacccaagagtagacatttttaaagtaagttttaatacgtaaggctgctaagagggctgagaagtggacgatgttatgcctgttggcatgagagtgaaatgatttactagaagggaaaaatagcttactcctcctgggaggcatcttaataataaatagtaaaagtcttacattccctttgagtatttctatttctaagaacttgaagaaaactccacagacatacacaaaatgccaccttcaaaaatgctaacatcacagggcaattttaaattgaaaaagtagaaacaaatatggaatatcaagaatttagtaaacacatcacaaaatattaatgtgcaaaggggcatgacatatgtaactctcaaatggttcaaaagaattctaaaaatggtaataatcatctctctctacattcacaaatgcacacaccaaaaatgtgtatatgcacacatattaagggagaaagtgataaaacaactgtgatagaatgttaacaactgaagcatctgggtcatagttacatgggaggttctttgtgctagtgttccaactcctctgtaggtttaaaattttttcaaaataagctaaaaataaaaattcagcaaaggaaagttcagaaaggaacattaaagtcccattcactcttcattccccattcctctccacagataatactcttgtaaaacttttgttgtttattttagagatgcaactcactatgttgcccaagctcaccttgaattcctgggctcaagtgatcctcccacctcacgttcctgtgtagctaggactacaggcatgtaccacagtgcctggcttaaaacattttcaagttgtacaagtatctttaaaactctaggatacttttcactatatattgagtaaaaatcatatgtatatattaatataaatcattacataaagtatcatttcagtcttttttaatgtcaataacaaagtcatcaccataggatggtactgctaattttattttcatcttttcagtaactgtattttccaaatcttacatggtacatggatgacgtgcaatttttaaaaaagtattatttgaaacaagatactaaaaattagttcatgtcattttccaaattctgacatgcaatataatatgagagatgatgcttaaagtttggactccagagtcagaaatacctgggcatgaattccagttttgaacttaagagctatgtctgtatctaccctatcacttcctctggtttttgcatagaccctaattgctacttcaagaaattctaggtaagcaaaatgacatcacaaagcaaacttttccctctttcctgtgggctttataaaatataatcttggaaagcaaaaacattgccctcaacgcaaatcatattatagagataaaaatgccactaaccacagtttaaaaaataagattgagtataattaggtataagacggaaaacatacaaacatctggatttatgctagagtagaatttatttagaatttagttcagtaagttgtagtgaacaaaggcattgccaacagctgttgtattagtccatatcagctgttaaaagggatatacttacccatctaatattagactttcataggcagcttttttgtcacacacaggacaaatccaggtgggctttttctcattcatttgtagatagagggcagcatcaaaacactgcagatgtgtacaagtcactgcacggcatgggattgtcagcctcatttttcctaactacaggacaggaaacacaaggaaaactatttcagaaaggagaatgagctcagagggaacatggtcagttgtaaaagtcggaagatgtcatacaagaagatgataaaaatgaaatagaaatccaaatcagaatgtattcccaagaagattacaatatatttttattcattgactgccctatgatttttgaaaaaccatttcactttttcaaaacgggttaacatgtaaatccagattcatatacattgaaagtatgactccttcttacctggtccccagtttccctatttagagaaccactgttatccatctcttgcatgtcctttcacagatgttctaagcataaaccaagtgtgtatttaaagaaatattttcccaggaatgatagtatacaatacacactgttttccaactcacttctgtcatataacttggtgactactgcacacaaatcggtatataaaaagctaccattatatgaaggtatcataatttatttaatcagtacactaatgactgacatttaaattgttcccaatcttttatcactacaaacaatgctgtaatgaatatttctaagatttttatatttataatatttataattcctagaagtataacttttggatggaaagaaaagtacatttgtaatttttgtcacattaacacactatcttccacaaaaagtacctattgggttatgcatacatgtgtattaacatgctttgttccactcaaccttttcaatataatgttattaaattcttcggtctctgccaatctggaaggtgacaaatatcccattacagttgtgaactacattcctcttattttaagtggtagttgagcctcttcttttacttctaagagtcacttgtgtttctaagaactttctacctataaccttttctcatttcccatttggttattaatcttttgttatctatttataggcactctttatataagaaatcacgtgtgtaacatgaactgcaaatatatttttcatttatgttatttataggcactctttatataagaaatcgtgtgtaatatgaactgcaaatatatttttcatttatgaaaatttgtttttatataatcaactgtgtcaatttttcaacatacttttgattaactttagtgctgttaaattcttattccaactagtagtggtccactggcaccaagacgtacacaacactcagatttgatcagaccaggttttcctacataatccttcaaacctccccatatatttcctttacagaaaatatcactgtttataaccagtcctgctattttgattgaaaatttgtttctcccactagatcttatgctccaaaaagacggtctagatctctgctcaccactgaatcctactgtcctagcacaatactagctgacagtatgtgctcagtatttgttgaccagataggagaatgaatggacatggactggaaatggggaaaagaacaaacaggaaacgaagaagacggacctatttttatgctataaagtttgaaagaattcatggcaaaattaaaacattcttagctctgcctgggaggcaggctttttaggatgttctttttcttttggttcatctgtaatttctaattcctctaaaatgaacacctggtaatgtggtaatttaaaaagaaaataatttagctgaatcatcaacacagaagtaacgtttatatagttctacctacgtgcaaggtacagtgttgactactacttcacattactctcaaaaacactttcacaattacataacaattatactaaaaggatggtattattaccatccccatgttataaataaggaaactaaggcacaaagaagctaagtaacctaacgttacaaagttagaaaatggcagagcaggtctgacctgggaagctccagccctgcagagtccactctctcactgctatactgcctctatctaagtgtctaaccagagttctaaaagggagcctcgaaattactgtgattcgatcaaggtatgtggcacgatataactcatcacttagaacagaaaaaggtcagaataaaacctggggcagcttctcttcttatgatacatctttctatatttttcctgcctttaaaaacaaattatttcttaaacagaatcttacagtatgcccaaggcttttatataaatctcataaaatcttcataactctatgactccagaaaagctggtatctacatttctatttctgaaatgaagatgctgaggctacaagaggttaaaaccacacactcactgagacacagctgatggagctatatcacaaatccaaatggtcctcacatcccagagacatgccagttttataacattacaaatggtgttagttttttaatttaattacccaccttttcctcctttgctaagtttttgttctattaaaaatgaacgttgactaaatacctattcagcacccaatgagataaccggttttttatatcctttcaattataaaatgaataattttaatagattttcatattatcctttttaaaaatcacatgttattctttttaagtagtaccaacataaatattggctggttatttagaaattttccaccaatgtaagtgagttggcttttttacacaatcactgtgtggaaacaactcaatcactaaacttattattaaattacactatacctattcaacaaaatgcccacaatgattaaaataagaccaatctacacatactaatatacttaagatacactgttaattaaaaaacagcaagccataggacagtatatatactttccaataaacatacatataattatatagagaattaaatctggaaaaatctatcatgctactagtaatgttacttctgaataacagaccttgtgaatttaaaatgatcatttttactttttggttctatttgaataatctataagtacctatttgtcaatttttataattttttctttaaaataacgttctaactcagcctaccacggtttttacagttatcagttctcatttggtttcaaaacccctttaaactcttaaagattaagacctaggccaggcacggtggctcccagcactttgggaggccgaggagggtggatcacctgaggtcaggagttcgacaccagcccagccaacatggtgaaacccaatctctactaaaaatacaaaaattagctgggtgtggtggtgggcacctgtaatcccagctactcgggagactgaggcaggagaatcacttgaacctgggaggcagaggttgcagtaagccgagatcataccactgcactccagcctgggcgacaagagcaaaactctgtcaaaaaaaaaaaaaaaaaggccgggcacagtggctcacacgtgtaatcccagcattttgggaagccgaggcgggggaatcacgaggtcaaaagctcgagaccagcctgaccaacatggtgaaaccccgtctctactaagaatataaaaattagccgagcatgatggcaggtgcctgtaatcccaactacttgggaggctgaggcaggagaattgcttaaaccaaggaggcggaagttgcagtgagctgagatcgtgccactgcacttcagcctggatgacagagcaagactctatctcaaaaagaaagaaaaagaaaaaaaaaattaagacctcaaagacattttatgtatgtgggctatagttatcaatatttgtatattagaaattaaaacatatttttaaaagacaagagtacacaagcacacattccattagccatcagagcaatgacatcatcatcatctattgggtaacccacgttaaacatcactttatgctcctaagagaaaaagaacacaaaatgccaaaattgtgtgtccatattattataaaaagttttaactttgtagttcttttcaaagagtgtcagggaccttcaggtatccatgggccacattttgcaaactgctgtttagggattgtttttgtcgttttcttctatgctgtttccatctctcctgtcacagccttaaaatttccacagcatacagaaacgagaatatccaggactataaaagttgctgaccctaaatttaattctactctagtggtcttataagaactaatgagcatttcctaagaaggaatttgttaccagctagcaaaattttatcaattgcctagtgactatggcatgttattaaaaaggacctgaatgtgccaccaaaataaattctaattctaatttaatcagatgatgatgcttttttgaaatttattatttttatgaatggttatctaagtaatgcaacacttttttcctataaaatgttaagctggcattatccaaattctattcactgtagactaattactaccaatctaaattaagagagtttttaagttgaaaaggcccaaaatggtggtttccaactcttttcagcaggactttttttttttttttaaacatactagaatctcaagagataaaatcaaacctagctttctttctttctttttctctcccccagctacccagtccacctctgcaggacagactgaaaatcactagctgaaatcaccaaagtgaaactcctatgtaaaattcagatatggtgttcagaaatataattatgcacactcaattagatcctcttcagtaactactgtgacattaccttcctttagtcccaaggacagaggttttagaatttgctcccacttttcagactcacgtccactgcaaatcactttacgaaaatactgtgaaatgtaataaacatttattctatcaccctacactatcattttctcttgtttttgccaaataacccagggttcacttcttatttaagtgcctgggatttatttttttccttctccgtttcccattactgcaccagatcccatgttatttccattgttagctggctggactccattctgctttctccaactgataataggacttactctttctcaaacactgctttcatcatctaacttctgtcatccatccaccaaatctaatcaaaacacctgtgtctggtattctaattaatatataccacatattacagtttagctacccaactttatgttaacactactactatagcccaaagagtagcattcattcttttcttagaaagtgctctgaaaagattgatgaacccccaggaaaagctcaaaagacagtctcacgaatagacctgttgtcacttctgagcagagagaaaaaaacatttcagaaacttaaaacaagatttcaaaaacctatttgatctgttacttcatttcttcaagtaactgaaaagttaattttcttaaaaattggtaatgtttggaaggaactgctccctattcttacatagaaggaatcctaacctctctgatacactactttcactattattgaaagtttggctaggtgagatggctcatgcctgtaatcccattattttgggaggccaagatgggcagatcacttgaggtcagaagtttgagatcagcctgggcaacatggcgaaagatctctacaaaagacaccaaaattagccaggtgtggtggcgtgtggcggtagtccctgctactcaggaggctgagatgggaagatcacttgaacccaggaggttgaagctgcagtgagctgtgttcatgctactgcattccagcatgggcaacagagagagaccctgtctcaaaaaaaatttaaaataaattaaaaaaaaaaaaaaggatatgttatgaatgcaaaaaaaaaaaaaaaaatttaaaaagcctgagaatctgttagtatgtttggccattgtattttgttttggttgctctcatgtagaatggcaaactgtatgaagaaaaaaaatttaaaagattctaagaaaatggcactgcacaactgtaaaactccttaggtaagttgtgtagactttcttcctgatacaatagtttgacatctaaaacataatggtgacacgagtttcctccccatatggtgactgtatgtggaatagagctggcaattaatgtttgctgaatatactagggatacataataaaaaatcgtcaatatccaactgttttttaaccaacaaaaaggcaatttcacttgtttcaatctactatcaattttgattttaacatgagagcgaagaaaagtataataacctgaagatactgaaaagaactcatgcctgaaggtttgcatagagcctgcactcagaggaagtcgtgtgtccttccgcatgcctcctagaacctctgccaacaccctcagggctttcaggtcttaccctactggaactgcacacctcttccctgcgtttgctaagagcaggttcccagtatccaagcaatcctcatatcaaaaaattatatttcaataaaggcaaattcatgtttttaagttaatgaagattaaaagagtgacacttcaaaaaaagatctgcaaataccactttccagaataaaagagatgtacttgtaatcaggacatgtatatttcagcccaatctggcagcatggtatattggaaaaagaacaggaatatcagaacactacaatctttatccttgttctaccaataactgtgtaatttgggttagccaacctcattcagtctcagtttcttcatctacaaaatgaagacaactcctccacacaggtttgctaagacagttaaataaaagaacatacagtagagactcaacaaatcattctcttttctgacacaatttctccccatttaaaaaactgcacatttctcaaaatggtgggtagtcatcaaatacccacaaaactacattataaattcctgattccatgactttttctcattaagttcttcttaaccggaaagggttcccctccaattcattcactgctcctgaccctcccatctcctcttggtagtaaaacagcctaactgtaagtgaagtctgcaccatttttatgggagttggttttatttttcaaactcaattattaacattctaagcaagcctcaatattttctcccacaattagctcagtggcaagtacacaggaggatgtgagagttgctgactgatttctccctcatactttctatgtaaggagatataaaagaaaaattattgtgcaatttaaaagaacattacaaagacatcctacacatcctaactcactaaactaagaccatcaattagcatttatcaggccctagtcactttattgctatttttcagtatcatttatattctgataaaaggagtcagctcttaatatatttttattactagctgtatattatctacaacattaattacaacagattattctgagcctaaagctatcttccctcttctttgtattctttgcatgcccaaataatacaaagaattgtgacttaatcatgaagattccttaatgggaaaagacaaaagttcagcattcttcataatatatcattcattcccacacttacttttataggaaagttaatcatttataaaaagtcaaattccccaaaatgttttgttgctttacttacagggcacatcaaggatacccgaaggctagttgtagcaatttcactatcaggatctgcagtaagtttttctttaactttaaaaagaagagaaaaaaaaaaatttaaaaaaattaagggtgacaaagaaatggaattatagaaatatatagcatcttaaaacaaaatgttacatattaatgtattgacaacacgatcacactcccaatataagttaaagaattatgaacatgcaaatttctttgtttaaattcttaaaatttctttttaaaagtaaaactgctggcaagcaagactttcaaaatagaaagctatgtaagacttaagaacaaaacaacaattaggagaggaagctggaatgcagcagtaccctgagcgtcaaagcttttccaacacacattcatcacagtttttattatgcactattgtttgtttccaacaattattaaatttgtaaacagaaaagataaaaatatttatacttcctttgataattaaaaactactatgtggtaatgtgtctacaattttactcaccagtaatgtatataaattagtatatacacaagctaacaaatatatactaatatattgatgtgagcaatatttaaagcattaaagtatctcatatgctcaatctttttttttttttttaaatgcttggtcttattaaacattacttacttagtgctctggaatgatcagggtttctaatacctttcatttttaatctctgtaataacatggctgatgtaagctgccgtacaagatatacagacatagagtaattctacaaacaaacaaaaaaaacctgcattaaagatgagagataatattctctttgtttacatgaaatacttatttaagaaactctggtttctaaaaataacattcaaaataacttccatggaatggtcaatcactgcgaaggggacaaaattcaccaagctacttcactgaaaataaaagctcaatcattttaaaggtatttcttgatcatttatcactttaaaacattcgctggtatgggaatataggttagatcaatggtttccaaactatggttcttatttagcaaaactggtaccttaggggccaccctgaaaatgtaccctcctatgactaaccagaatcttgctaaccaaaatcattctgcttttatcgactttatgtaatgaggttctcatattttcacttaaaagaggaattccactgcagaaacaaattccaaaggccagtggtctgaattaacactgcaaatccagagttccaaagttctaattctggcagaagaaaccacctgctactacatggcctttgagtaaatcacgcaaatgaaccaggtatcagctttcttctgaggaaagctttgataaattaactcctgtaccccaaatgggtattttattgacaagcagcagctactatagtatgtaagacacatgaagaatgataaaaattaaaaagtcaagccagaaaacaacagcgtccaatcccatacctgttagatctggcacaaaggaaccttcattagctatttatagagctatgaacagacaaaatataatttcacataaatgttaaaaaaaaaaaacctatcttcccattttattaaatatattcattcaattgattctacaataaacatcatacttttaatagctgccaaaccaagtattttaaatattttttaatgttcttttagatatctaaatacccaacttatggtgtaaattctaggtcaattaatcattttaattataaggaagagtattatccccattacatggcaaaagttttcaatgtctacaatcatttattccaatgtctgtaaagttactcccagctctgcaattaccttggtggtaaaacaaaaaattcctgctataaataatgcctcaatttctccatccataaaacaggaatattattctgtttaggaacatgtaataagaacactgaaactgatgcttcatgtaatattaacactgaagctgatggtcagaaattaactgaaatctcctttccattcattatttcagttatataaacaagtaattctaaaatgtaaattccttgttgtattaactggtatctcaaaattgacataatttattataagaccaaaaatcaacagaaagtcaagttcatcaacttgaaggtatagagaaaatattataattctaagtaaatatttttatacaaatgcttacaggttatctgaaatatcagttgtttatagaaaggctagaacagattatttctaatcacaacatgtgtacatttaaccatttctcccccaaacggataaaactttctttgttcctcttcataaatatttatcatccaaagcttctagtttattaaaatactaaacacaaacatacatacaattgtggttaaaccattaccttaagaaatataaatatgcatatttcctttccaggaaaataaagagatgatattcaggaaagctcagagttaaagtttttaactttaagaatctccacactgccacctctaaactgaaaattactgctttttagagattacaatccaaaaacagaaagagctgaagccaacagcttaagaaaaaacacagaaagtcaaccctcagtggggtcactgtcctgctacccaaaacggagagcttttaccttcccaatttctgatgcccaagaaatggaaatttggtttggcacagctgaagataacctaactaaagatgtaatattcaaggggcgtccagggcgcttctgttcaatcccatttttaggcggtggtgcatagccctataaccgtaagaaagaaaaattatttcaaatcatctgcaggaagattaaacattttctccaagatagatacaggatcctgcccaatttcagttacactatttttattttagcctaaaaatcatatagcccttatgatcattatcaacccaaaataggaaaataacctttgaaaaaaggttacaaaatatttcacaagtccagaaaggtaggaaaaaaatccatgttccaacattaaaattaaagatgctgacatcttgccacattggctatgaatggttttcctttttcataggacaccaagctttacagataaagtcacaactttttataacgattcatccttagcagtccccattcaaaatacatgcacatattggaggtgggaaagaaaaaaaccaaactgggaagtgaggggaaagaaagaacaaactaatgaatttcatttttaaaatctggtgagtgataaaaatattttccactgccttttctctgggtggaacagaaatggtaatcttttaaaccaggttaagttaacaaataaggataatcaacatttcagttgtcattaaatgagcctgatggctatcaaaatactgctatttatgctttaatctacttttatgtagtcatcaaccgtatttttttttttttttttgagacggagtctggctctgtcgcccaggctggagtacagtggcgcgaacttggctcactgcaagctccgcctctcgggttcacgccagtctcctgtctcagcctcctgagtaactgggactacaggcgcctgccacaacatccggctaatttttttgtatttttagtagagacagggtttcaccatgttagccaggatggtcttgatctcctgacctcgtgatcagcctgcctcggccttccaaagtgctgggattacaggcgtgagccacagtgcccggccaactgttcgttttaaatagcaagtatactcatttctgattcgcagtatatccaattcccaattaccgcaagacttcactctgatttttcagagccaaaataatatattttttagaaaattaaaatgtcttagctgcaaaaaatctacatattgaaaagtagataccatatttcactgatgctaggatgtcagtgatgtaatttaattatgtactattgagaaagagaaaatactatgtatatatggcaaagaaatggaagcaaaatgaattaacatattcccttttgtacagaagaaacttctgaatcacttttcactcagtcattaatgcatacatttttccacatgacactctcctatgtgcaagcaggaattttagagagaaaagtatcttttaaaactgtatttcattccactaatgtctcagatttctctgcaagtcactgacaccattaactggatgtgttaatggggatacaatctggatcttatgagaatccatcaatgaaaagttttcagacaacagccaggattcatgcttctttctcaaaatgtccttaaattatttattaactgaaaagccagggagtacagctaaccagtcacgccatgccaataacatcaaagttgcacaggtgcaggcaatgataatacgtcacagctgacacctggtcaccagcaattttaagacacttctggatttcggcaatgctaaaatatgcaccttaggaccaatgaaaactagtactggtagtatcacaagcaaagaggaacacaccctgtctaccacaacttgggaacacccttcactgtctcataagaggcaagacagtaattattaaatggtagtccacatgataatgtgtaatctataacttgcaacaaaattctgaaaatcattaaaaacgtttgagcaggggaataaaagacaaagagaagaacttcaataacttgcattataatatggaaatgaaagagagagacagtgtgtgtgtgtgtgtgtgtgtgagagagagagagtaggaaggttatgcccatcttaagttgctcaagtgaaaaaaaaaaaaagttgctcagaaaaaaaaaaacaactcctaagaaaagtcctctcataaagactcaaggagctgattcaatgagcatcaagcacaaggagtatcaacaccagtatctaggtaattttgaacaaaacttttgttttgcctgttttgggcctggaagataattctgtctgctggtatgtccactggtaggttaaccaaataaaaataatgttacagggtctgtcagaaggatagaaataactcatgaactaaaatgtgcactctggaaattagaatttaagacataacactgtctgacacagtagaaaagggcaacagaagcagggagagtaacactcatgtaagaatgaagtgtcagcaaactcagaatcattttagtctcactcagcataaagtgttttcaatctattctgtatcccatttgagtagtgtgactttactggtaattctgagttatctgataacttgtattctacctgtaaccatcagcaccacccctacccaaccatcaatttcctggttattgataatatattaatagttggaattttataaaatataaagtttagccttcacacatatttctaacaattttccatatttaaagcaaaaataaagtcaagttcatgtgacagggaaccagtggggcaaatatgcgagctttctaagcaaaggccactggacagcaccagcggaacactttgtggtagtactgtgacacactcaaagaattttttatgtttcatgctctgatgacaccctaccctacttgcaactgtgacaaaagttgtccacaattattgtactttaacattttcctccaaattttctaattaccactactacttgaatacttctaacaaagatttactttttaactttaaattacggaaatttcaaacatacacaagaaaggaacaaatagcagggacccaccaaccaggttcaataattatcaacatgttgccattcttgtttcaaatgcttttggccccaaagccagtctgccctaaaacacacacaccacaaaaatacacatttctttttgtccttatttaaactcaaattctagacatgccatttaacccagatatttaacatgcatctctaataagactttaaaaacccacagcattacaaccccacaaaaataatcacaattttaaaaaatcacctaacaccttgtctttcgattcagatctcccaggtgcctcaaaatttcttttcctgttatccttttattgttgaaaattttaaacatatacaaaaatagagaaaaaagtataatatgtatatatctaccagttcagtaatgtacttacccatgaacaatctttacctactctacccaactcccactctagattattttaaagcaaatctcagatacattttctattttctccagatgtagtttagtatagatgtccttttacagcttgaatcagaattcaaaactagagccccacaccgcacttagttaggtctctgaagtctcctttattctataaacataacccctgccatctccaaacacacacactttttccccaatgctgttgttctactggagaaaccaggacttttgacctgaagaatgacttcgcattctagattaggtatattgcttcctcgaagtataaggtttgttgctctacctcccatatatttttaaagccagtcattagttgtataagcttgattaaacttggggtaaaaattttagaaacaaaaaacttcacagaaaatgttgcatacttcatatggtgctacatcataaggcacagaaggtggtttgccctgttttcagtggtgtcaagattgatcaggagttcaggggatgtcagcctgattcctctaccatgaagttccccgtcaagcttcggcatccattgatgatagctacctagacccattatatgattatgaattgtggaataatgattttctaattctattacccttttgattgtattagccgaaatgtttccataaagagcttgaccacatcaacagctggtcaccttgaaataaatgattctcttccttcatcaatcttcggagcagcagtgagttagtgcaacctccagtggctttagtataattattataagcacacttacatatttgatagttttgagtctactataatcattattctttcagatgtcaaaattatcccttctcaggtaaggaggtgcctcttcaaattggggtgagtgtgcacacaattatgtgttttaaaagaagaaatgttgagtttatgtcagtcctgatttactatgagacaggccatcagggtaactaacacacaacatcagggaacataaatccatgaactcagaaatacaatttataaggagaagggggccagtactgctaagtcttctggctgcaccaaaggaactacttggagattgctgccagctgaattacagcacatatcctctctactctttgggatctttaaaagaaatattcttgtcaacccttcttcctttcttcaaccttagagctacacaagatttatagatatttctcacaaattgtttagaagaaaaataatccagcttcttaaaataactccctaaacaaagagggcctttttctttcttctgcccattaaaaacatggaatgttctcatctggctgtcagtctgtacactggcagcccttggagtcaaagatgggagatggtctctgcagcaggttcttgtctgtccacactgcatgtcaccatcccacaagccctactatgagctgctgtcttccttgcaccaagggaacctggaaaatgaatgcatgaaggtgttttgtaaaactcagcatcttgatgtaggttaaaaagcacatatgctgcttgcatcactatttgatccttaacagtctagggacacgttgccattttcaaagtaataccatttcccattcctatgtttactttgtacatgaagtatagtggtcaactgccatgggtccataaagactgggtattacagtaagatcatacacataaggacttcttccaggacacagacaaatgccaccatattcagagctctaatgggcaattcatgactgtgtcaagcttttccctccaggattcatggttcaatacaccaggatcacgggcaaggaccacctatcaaatttcttttgtggcttgttgatgcttcttaaaactggaacaaagtccctgaggctctccatggtggcaagagctcactataactcctatagggccacagcagctttcttcttctgaggctgcagcatactcacgtaattcttaaaaactgcagaatcttgttttatatttaaaaagactccacatttcattatcccaatcaatagcaactgtggatcaagtggtggtttaagatgttttccatcagatgcgcatgtgaatttctgtcagctgttctataggactttacggagctagggtaaaaagactctttgggaaaggcaggcatttgattttctttgggatggccctataagggtcaggcaaatcctccccattgccttctatttttgaaaatatgtctttgcctttctctcaatgctctatttcttctcctccttcacaactgcccatggagctgctgcaggcccctggctccagggatgccagactcatcagacaaaggctgctttatgtagtagtcaatatgttcacaaatagtctaatacaagtaatcaggggttagtgggtgctttgggacagaaatcagcagtaactaagtaacaatgccccagaggaagtactcaactgcctaaattcttctccctcaaaagaactggaagagtaacaaactccaagccatcctcagtggtactgtagacctcctacaggaaggtatcatcccaaaatgtgacactgactggtccatttggaaattctggtaacgtctatgtttacacatctgtagccaccatattttccatagcaatgccacagagtttaggcacaacctcacacatttcagatgcagctcccatcactggcacagtcacacgatgatacaggataagccttcaaggtgagtccacagacaccaagaagccctccatagtcttatctttcatcacagataatgggaggggcaaatagcaatgagagtcaaaggtcaaagaaatcttagcagccagacgcagtggctcacacctgtaatcccaacaccttgggaggccaacataggtggatcacttgagcccaggagttcaagaccagcctgggcaacacggcgaagccctgtctctacaaaaaatacaaaaatgagccagccatagcggtgcatgcctgtagtcccagctactaaggagagtgagatgggagaatcgcttgagcctctaggaggctaagactgcagagtgagccgagactacactaatgcactccagcctgggcaacagacctgagagcctttttttttttttaaataaaaaaaaaaaggaaaaaatgaaatcttagcacatctagggcaaagaaaaatggttatgaaaaggccatgggacaggtgcacagggttgtgtattaatctgttttgccaggctttctttgtcacacatgcagttacccattggtatctttcagctccaagtagggctgcttcttcccttggttcagatctttgtgcaaactagccaaataaaagataggccaggcgtggtggctcacgcctgtaatcccagcactttgggaggccaaggcaggtggatcacgaggtcaggagttcgagaccagcctgcccacatggtgaaaccctgtccctactaaaattacaaaaaccagccaggtgtggtggcaggcacctgtaatcccagctactcagaaggctgaggctggagaactgcctgaacccaggaggcagaggttgcagtgagccgagatcacaccactgcactccagcctgggtgacacagcaagactctatcttgggtggggatgggaggggagtgggaaaaaaaggatagctcctgagaatcttgttgctagtagccggaaacctgacaaactaaatgtcccacccggggaaacatgtatgggccatgtaagcaatcccccctgaccatacctactcagcctctgcaattccccttcactcccaggactgtctcaatggatttcagtctcagatgcatctttcaaaaagagtcacgtcagtgatgcagtgttgctcaagccctttaaaggttcacaaaacaagtatttctcaggtctctaagtccacaggctgtgtatgcgacaaatgagactcctgacaaccaagagaagtcagatccctctgtccacaagaccagggtcagtctcagtcatggaatttcttcactttggggcccaattcttagcacttggctctggagagcccagagtcctagatcatattgtctgacttgcttggctactcgtgagtactgctcatatattagtccagagcccagtctcgtgttcagcagggatattacacagcttccccatttcctcaatagttgcgaagagtgtcagctctggtgaaatgacaactgggcctagtcagggagtcactgctctcttagtgattcagttacagtaaatacacctccaactttgtagtgcttgacaaacgtgccatgttgtactatttttttgattatggctttgctggccttcttacagaatggtaccaatttagtaatgtatccaaaatggaaaccaatacatagtccagttctacatttattattttattttattaagacttgactatcaggatttgaagagtcaaaagccatctattaggccagagacaggctgcatgcatttacattgtatacatcctaggtgctgaagcccatatactctctcactgcttaaatgtgttgtcaaccaactattattgcacccacccaccacaagtgaatgcatcatcaaggcccaagctgggaatttttgatctctgtagttagccactctcagcagcctctgcttttccccatgccatccacaggccaggcccagctaatgcagacatcccacacatgctgtcctatacatgaaagtgcccaagtcctccccttcaactatgctgtttgatatgatcccaagagtgtttcacagcatccttgatttcttaagtaagatgctccaggctctagccaggtacagtggtgcacaactgtattccccactactcaggaggctgaggtaggaggattgcttgagcctataaattcaaatcaagcctggggaacacagtaggaccttgtctctttaaaaaaaaaaaaaaaaaaaaaaaaaaaattccaggcttatgttttccatctccttcagacctgaaataagccatttattatttatccaagaagccatgggttaccctagtggaaaatagtatttaatctggatgctaaaactgttcactggtattcagctgtcactgttgcactgtttctaggccttgtcagtgtttatattaaacttatatgcaaatctggtgaataaaaagcaacttacaggcaaaggaaatagcttcccatttacttttatacatagactatttggatagttatcttcttgagggcaacttgtctctgccaggcaaagtctgcattaataaaagaaaaaagtattcttaaatagtgtgctcaaacattcttatatgttttaaaattcagaactacatgcacatagtaagcaagtataaaactaaggtaacagaaaatttcaaactcacctcaactgaacttggactgtataatctctcctaccacctggcaaaaaatccctgttggaaagagaaagaaaatgggttaaaaaagtacaatgagaattctcagaacagtctccccaggaggaaaaaaaggaaaagcattatttgtatttttcttattccctgaaaggtgatcaatatactaccaataatataagccttaatgaaatcactgtaatgatgataaacctgacttgcttaacttctagccacgtctttatggcaattttaaggtaccttcaatgcacaggaactttgatgatgcaaaatttatttcaatagacatcaaacttggtaacatgcaaggaagcagcctaagttcggaaagagttttaatcagcaaatctatttgcttagagcattctaatcacttgaagacttttttctttttcttttgttttttttttttttttttttttttttgagacagagtcttgccctgtcgcccaggctggagtgcagtggcgcgatcttggctcactgcaagctccgcctcccgggttcacgccattctcctgcctcagcctcccgagtagctgggactacaggcgcccgccaccacgcccggctaattttatttttatcagagatagggtttcaccgtgttagccaggatggtcttgatctcctgacctcgtgatccgtccgccttggcctcccaaagtgtctcattacaggcatgagacactgcacctggccaaagacttttcttttactataaagacctattcactggatattcttattgatctcaagtacagcctaagcattagtttttatagctactagggggattctaatatagacccaggataaagaattagtgcctagagtctcagcatctccataccatgcaacttcataattatgtatccaattaaagatacagaacctcttataatttctagatgagaatctaatggtcccatgtaaaatatatttcatactgaaccctccaaactcttgccacgcaacatggagtctacggggaagcagcacttattccttaggagcttgttggaaatgcagactctcaggccccatcctagacctatagaattagaatctgcatgttaacaagatcctcaggtgacatgtatacacattacagttttaaaaagtattgcccttagccattgtcataaatcttggactctgtcagagagaagatcactagagtgtagtcctttcttgagaagactggagtacactgagcccccatggtgctctaactgggccagtctactcaccgttcccaatcctcgagctccactggaaggcagtaaagcacagcagtgacaaccaccttaagttctacagtcccaagctgcacaacattgtgcaaatcacttaaccattctgtgcctcagtttctacatctgttaaagatggaaaattactgcaccaacctcatcaagttgctgtgacaattaaacatgttaacaacacatgtcaagtgcctaaatataagatgtgctcaacacatgggagcagctggctgctgtgactgtttccactgctcccactgttctccttaccaagagcagccttctcaaatggctattcaaaacatccccatatccttgacaatactgacctcttctgagcaacccatatcactccactcattcatatcaagacacatttcatattctgggtgctggagcttcaaagacaaatacaacacagtatttgcttcaaaggatttatatgctaagtaggtaacagaaatacaacacctaaaataaaatatggtaagtggtacagtacattataaaaagtaagtgctacagaaaaagggaaaatttttgtcttgaaagttcaaggtcattatcacaattagtccaatctaactagaaaacagggtttttacagcagtggttctgcctacttctgcttagtggctccactaggaacatgagtaactgtgggtatctagtgcagtaattcccagaaaaaaagaaaggacagagatacagatcagaaacttgttagatgggaaacacgatgtgaagaaagagaaaagacaagacatgagcctagaaagatggatgggggcataaagggttttgaacagctcactaaggagttacactttattctggcaagggaaattaacaaaaactgggaaatacaatgtgctaaatatcttcacaaacattatgagtaatgaccaaggcatcttctgacattcatttctgccaatcactgttctaggaagttttacatactggtccatcagatacaaaagaagcatttaccatatgctaggtactgtaatgggttgtgaggtgataaaaatgagtagaagaatgctgctttcattaagaaggttgcaaatgcaagcagtgaaataaatgcaatgatgccttaacagaaaataagtacatggcacagtgagagacaaatgacacattaaagcaaatctggaaaggcatcacaggggacgtatgaattgaactggcccttgaaacatgactcaagaagtttgccaggcagagtacagagaaaaaaggcggcaaaggtgcaaagatgtgaacaccatagttaacctaggaaacacaaatgggaaagcctagtcagagtacaggttgttagaaaagagtaacaggagataagattaaaaaaaaaaaaaagcagagcaagatgttgaaaacaactgccaggcaatggagtgtggactttatgaggtaccattagagtgtgtttaaagcatcaaagagaaaaaactgaatgggctttagaaagatcatatgtaggagctttctaatggaaagatctcataattaggagaccattacaattgaagaggcaaaaaacaagggcttgaagctgggcgcagtggctcacgcctgtaatcccaacatttaggaaggctgaggtaggtggagttcaggaccaggctgggcaacacagcaagaccccatctatgcaaaaaatagaaaaatcagccaggcatggtggcacatgcctatagtcccagctagtcagaaggctaaggtgggaggatcaattgagcccggacattaaaggctgcagtgagccttgattgcggcactgtactttcagcctgggtgacagagcaagaccctggctcaaaaaataatagtaatttcaaatgagggcctgaaagctattaaacataaataccactgagtgatattcacacataaaaaatggtaagacttgatgaatgactagatgtgagaaggcaggataagggaaggggagtttctaggagggtatccaggttttggaatgctgcaactgaagagatggccatgctactcaccaggacaagaagaggcagagcaagttatagcatcaatctcccaaaccacccagtgaggtggtgatcattattccaattttgcatgctgagaaagtgaggtttagtcacctgtctaggggcatacggacctaagtggttggttcagaattcactttatacttagtattactctaaagaccatactagctccctcaaaggtagagttgccttgctgagttttaaatattcagaatgacataaaagaatcaatgaagggccagacgcggtagctcacgcccataatcccagcactttgggaggccgaagcgggtggatcatgaggtcaggagatcgagaccatcctggctaacatggtgaaaccctgtatctactaaaaatacaaaaaattagccaggcgtggtggtgggtgcctgtagtcccagctactcaggaggctgcggcaggagaatggcgtgaactcgggagtcagagcttgcagtgagccaagatcacgccactgcactccagcctgggtgacagagcgagactccgtctcaaaaaaaaaaaaaaaaaaaaaaaaagaatcaatgaagtgcagcaaacagacaggatgtggtaaatgaagagtggcctatcacaaagaggcctctgtcaaggcagattccaatgccattaaggaaacgagtaatgcagaaggaaatatactaagcaaaaatctccttgaggccagtctgtttttcaacttcgcatctttggtgcctggaatattgtctggtccatagtagacagttaataaatgtgtgctaaatgaatgaataaaagaacaaaagataagcaggtttgatggaaggcaagctcaattttagatgtgttgtgcttgatgcccttgtaggtcaaaggagaggcactgaaaaaggtgtctagagggaggtgttggtaattttgcagccacccatataaaaataacaaagcacattaatgaatattatcatagagtagcaagaagagaatcccagattgatcccttaaaatgggtacaagaagtcagtgtgaggaactgagagcatggttaaaaatatactagtaccaaatggaaggagcagcgctaaagccaaaaagagaactgaatccaatgttcaatcttcacaagatgtaacagaaagaacaaaaaaacctggacaagaatgtattcaagcgtctagtctagatcttactaccactacaggcaaaggggagggagctagaaacacagctgtggttctcaagttggctgcataccagaaacctgggaaactttaaaaaccactcatgtttgggttcaatcctgagattctaatttaactgatgtgggataaaacctgagtatgagaatttcctaaatctccccagctgatgctaatatgcagcaaagtttgagaaacatggggagagaagtagttaaatgacacaagaagcaatcatccgaatccagaatgtacaatatgctagatcaaatagatcactttttttggaaagtagtgttacaaaataaagcctaatgagagaaaccagggctccctggagaactgatcaattccacagttgcagcagagaaaatacaagataagccttcagcatttttgttgcaagaaattaaagagcgctcaaagtgggtttcagggagagaggtatatcaaaagggcataggagccaacctgaaagaacttctaatagccaaagatagaacaatttgagcatatcaattactgtaacactggaatataactcatagagcacccatgagtccacactgttataaacgaataaacgggctgggaatgctggctcacatctgtaaagccatacctgtaaacccaatagtttgggggacaaaggagggaagatcacttgagcacaggtgtctgagactagccgaggcaatactgtgagaccccatctctataaaaaacataaaaattagccaggtgtggtgttgtacacctgtagtcctagcttcttgtggggctgagatgggaggatcatttgaccccaggtggtcaaggctgcaacaagccatgatcaccaccactgcactccagcctgggcaacagagcaagaccttctctcaaaaataaaataaaataaaaggccgggtgtggtggctcacacctgtaatcccaacactttgggaggccgaggcaggcggatcacctgaggtcaagagttcaagaccagcctgaccaacatggtgaaaccctttctctactaaaaatacaaaaattagccaggcatggtgaagaatcgcttgaacctgggaggcagaggttacagtgagccgagattgtgccactgcactccaacctgggcgacggagtgagactttgtctcaaaaaataaacaaacaaaatgaatgaatgaaagaaagaaaagaaaaggagacagctcctccttgtaaaaataaaataatctcaatgtaaaaaagattaaggacaacagaacacaagaatgtttttgctaaagtaaccactaaagccaagattcacgagtgaacactgaattaatctgcaaaagtttgaggaaaaacagaatactaggtgcctagttgcaaagttatctttgcaaaatatttatcaacaaaggaacaaacagtaactttacagtgcagatacctggcagctagtatcagccaagtgatcaaggttaacatcaccaaaaataagatatcaatattatgttgcctgatatggtaccctgagaagggcacataacttgaggtattcttgccaaaaatgcacaacctccatctaatcatggtaaaacatcagccgtacccccaaatcagaaagagtctacaaaacacctgatcagtactcttcaaagtgtcacgctgtgaaagacaaaaaacaaacaaacaaaaactaagaaactgtaacagattgaagcagagtaggatgactcaacaattaaatgtgatttgggattgtatctaggaacagaagacgtttattgaccaaaaaactggtgaaatctgaataaagtctgtagttaatagtactgtaccaatgttgatttcatggttttgatcattgtactatggtgatataagatttaatattaaaggaaacagggataaagaatatatgtattatttctataatttttatctaaataaaaattactacaaaatataaagtttttatgccgggcatggtggctcacgcctgtaatcccagcactttgggaggccgaacaggtggatcacttgaggccaggagttcaagacaaccctggccaacgtggtgaaaccccgtctctactaaaaacacaaaaattagccaggtatggcggcacctgcctgtagtcacagctactcaagaggctgaggcaggagaatcgcctgaaaccgggaggtggaggttgcagtgagccaagatcatgctactgcactcactccagcctggatgacagagcgagactctgtctcaaaaaaaaaattatgtaattaagtacagaatttcccaaacttacttaactgcaacaatcttatttttgaaaaactcttactatcatctcaaagagtgttctaattaatatctgaaaaggaagtaaacacctctaatttactcaattccttgctctgcttttaacattacagccccccaaaaatcattaacctcccagaagccttagttttatcatgctgaatcttttaagaatgcaactttaaagagtcatataaataatgttttgttaacactaaaggtgtgtgtatacatatatacatacatatatatacacatatatacacatatatatacacacatatatatacacacacacatatatatacacatatatgtatatattcttttgagatagagtttcactcttgttgcccaggctggagtgcagtggtgcgatctcggctcactgcaacctctgcctcctgggttaatgtgattctcctgcctcagctttccgagtagcagggattacaggcgcccgccaccatgctcggctaatttgttgtatttttagtagagatgggtttcgccatgttggccaggctggtctcgaactcctgaactcaagtaatccacccaccagagcctcccaaagtgctgggattacaagcatgagccaccacgcccagcctttttaaaaatatttttaattggaaaattaaatgctacagatttccttttctttcttcttacatctcttagttcatctgctctttacaaatgggtctaccaatacttttcataattgttttcatatatctggtaattttttggtcaggatgactatacagctcactttacccataactacctcagtttatgttcttatctcagaataattattagtaatgtttactttcactctcaaaaatgccccagtttggaatgataaagcttatggtcaccctgtctttgggctactataaattctttttatattgctttacccaatatatatattttttcagatggggtctcgctttgttgcccagtctcgagtgctgcagcatgatcacaacagctcactgcagcctcgacctcccaggctcaagtgattctcccacctcagcctcctgagtaggtgacactaatttctgtatttcttgtagagacagggtttcaccatgttgcccaggctggtctgaactcctgggctcaagtgatactgccacctcccaaagtgctaggattacaggcatgagccaccatgcccaacctgggaataaatttttcatttaaaaaattattgccaaatataacaaaaagtaatctaaaagacattgaggttttattcaaaggttaaaaattttattctaacacacagtatttactaaatatttggctgactttagtcaaagtatactaccctttcatgagagaaacaggtcaactgttatggactgaattgtgtatccccaaaatttatacgttgaagtcctaacccccaatgtgactgtatttggagacaaggcctttaaggaggaaattaaggttaaataaagccacagggtaggtccccaatccaatatgacagtgtctttaccagaaaagaaagacaccacggatgcactagcacagagaaaaggccatctgagacgtgcaagccaaggagaaaggcttcaggagaaatcaaacctgccaaaaccttgatcttggacagaagcctccagcattttgaaaaacaaaagtctgttgtttacactgtccagtctgtgaaattttgttatggcagccctacaggtgaataaaccaatattcatgagaaatatattccaaatattcctcttacctggatatgcatatctctctaacttgttgaggtgtcaaagcaaaaataaaaaacttctcttgaaatcgctgaatactgctttgaactgggaagaaaaaaaaaaagaaagataatatttcaataacaaatccaacactacaaccacctgcaataaccaggcattttttataaagtacctgccaaattctgaaacgttatggttaaaatactccaaaatcaggaagtactaaactgcattcatcttggaatcatgagtaaagtcactacaaaggggtttctttaacgttaagtacgtaaccattctttattctaaaatactaatgcaggctgggtgcagtggctcacacctgtaatcccaacactttgggaagccaaggtgggtggatcacctgaggtcgcaagttcgagaccagcctgaccaacatggagaaaccccatctctactaaaaatataaaattagctgggcatggtggtgcatgcctgtaatgccagctacatgggaggcggaggcaggagaatcacttgaacccagaaggtggaggttgcagtgagccaagattgcaccattgcactccagcctgggcaacaagagtgaactccatctcaaaaaaaaaaaaaaatactaatgcacagtaaaaatataacaaaacgcttcaatattacatttcattcttaactataatattatctaatgaaaggaagtcaaaatgctccccaggagaactgtattcaagaattaaatgttttttgtttatttttctttgttgtattttgcttttggtgctctgtatttaattacacaaaacactcatataagaaaattttgaatgtcaaaacttttaagttttgaagatacctaatttgcatatgaaagtcttcccagttaaaaaatattgcttaatgaagtcacccttatgtatattattacctgaaatgtatttatgacttcacaaaaacctgcaataggttaataatgaattattcaataatgttctagtgtccattaaaacaaacaaaaaagttaatatatatagaggcctcaagtcttttgcttcctaacaattgcaacatcacccaagtaaaggcaaaatgaggccgggcacagtggctcacacgtgtaatcccagcactctgggaggccgaggcaggtggattacttgaggtcaagtgttcaagaccagcctggccaacatggtgaaaccccatctctactaaaaacacaaaaattagccagtcatggtggcacgtgcctgtaatcccagctactccagaggctgaggcagaagaatcgcttgaacctgggaggtggaggttgcagtgcgctgagatcacaccagtgcactacagcgatagtcttcaaaaaaaaaaaaaaaaaaggcaaatggtccttgtatataacactgtccagttttcctgctacatgaagataaaaaagatgccagttggatatccaatgtcagagcggttcaaccacaagtcacatcaagtcagaaaaatattaattccctagctaaaatattcttttctataagcacagtttattatagcaattattctcctagaaatgtcacaaaatggttcatattttttcagaacgctttaaaaaggagggaagagggagatgccgtttaagatgaaggccaaaaagtaaaataaaactttggattataaacataattatggagcatcaaacacagaaacataagtaagcctctccatttctccagttcctattcactcctcaaccctttttttcttgttcggactccacttttcactatctgtggctaaggtcaccaatgacctcttaactgccaaatgtaataacgtgtattttgagattacaagtaaacatgctgcattttaatcttaattaattaatgacatgagcatccagtctcttcagccagaaacctcaaaaggtctaaagtaagtacaaatggagaactaaaagaagagagtgcaaaatgagacattaaaaaagaaaactacttgcagaaataatgaatcaataattctacctttgatggaggggaaaaaaggatttacaaatcaaactccatgtaaaataatacaaagaaaactacctagtcacatcatagtcatactattgattatgtttgattaatcttgaaagcaacgagagaaaaaagaaacaagggaacaatgcaaatcaaggccaacttctcatccgaagcaatataggccagaaggtatctttaaagtggtgaaagaacaaactcaactgaaaattcaatacccttcaaaagcagagtggaagaataacttttcagataaacagaagatataagaatttgctgacagcagacatgcattacaagaaatgtaaaacaaaatcaccaggattattttaaaacataaattcaaaactggatctctgggaatgaaaatcatacagtaaataagcataaatgtaaaacagtatgctgtattttcttcttgtaatttccttcaaaagactgttgacagctaaagtgatggcattgaaaggcaggatttctaacacagggaggaaatatgagaacagcaaaaagaatggagggggtagataaaggaaattatctccccaacagttgtgtttcctgcttttttctgataaacctgaaatctccctaaagaccctgataaacctaaatctccctaaagaccaatccactcttagcgtgccacaagcagcaggtatctacacctgtaaagttgggcacaagaccctctgtgaattcacgaatataaatgccagtatttgaggctctgtctgaatgactggagacaacctaccctgaaaagtttccaaaacccatgaaccttaacatttgaaaagagaatggttccatagtcatgttgtacatgtatgttcaacatgtacttttatatcaaattgtacttacatgttgcacatacgcaatatatatgtacaatttatagaactggcagcttaatgttagtagtctgtgtcataacagacatattctcggtgtgccttttatttttctgacatatctttgactttacctatatttgctgtcaaattttcaatccagattataatctcaaataaccacccagtatctatagaaaaatggatctgtgtcattgctatatactataaccagactccaggaacttacagcaacaaaaaattgtgcatatgctaataaaaatctaatttgtattaacattgacagttcttagataagtcaattttatgacagaacagcagccaaaagcataccaaactttccataaagtgaatttgttagctaaatggttattttaacataaccatgagaaagaatgcaggatgcaaagtatgcaggttttgcagtttattttctccccattgtctacaatttgggaatcagaaaaccaattctgcagagattccatgaatgcctttaagttaagagcaaatgaaatgaaaaaagatcatggctcaagggcatgaattaaatatggctttattcaaacctttcctttttcaacaacccttcataatgtagattctattttccaaatataaccacattatctcccatcatgtcctcctttttatgtaaacttgacattcttccaactgagtagtggggtctttatcaacctccctttgaatctgaatggccttttgtaatagcatcaaccaacagtgtacagtttaagtgatgctatacagctccaaggctgaaccataaaaataccacacacatcttccttgctctgtggggacactcattcttggaacctagctctcatgctataaagaagcccaaattagaccacatgaagaagccacatatgggtattccagccaacagccaagctaagtccaagtcatcaggtggcatagctgccaaacatatcagggaagatgcctccaagtgatctgagcttctggccaagtgcacctcaagcatatgtcttctcagctaagaccccagagatcttgggataagaaacaagccacccacacactgcccttccaaattcctgacctaaggaatccatgagcatgtcagacacagtaagttcctcttcaaaggtttaatttctgacttccctgttctttgctcttaagctcaacttccttgtcccttctcctaagctatctgctctgtaaacaactacttctgccagtcccaatctgtaactcacatctcttccttatttggaaagagtcctctttactcctggctacccattctgtaagctccccctcttgctgagacagctctccctgccgaaactacccttcccgcctttgccgcaccctgacatgcccaaacatgccttgtactgtaacagacagcctctccctttccgcctaattagccatattcaattttaaatggtagccaatcaggtcagtgtagattgtgccgtctgactccagccaatggggaaaggacacagaaccagagattaaccgtgttagggataaaaaccccttcccctcctttgtttggtgtgctctcgcagcggccagaagtgtgaccagcacccttctgcagaagtaaatttgctttgctgagaaatccttcatttggcatttgggtgcttgttttccttgtgactccaagctcttgtttctaacaacttgggggctcatccgcgattgcctttctcatccaggaagaggtccctgatcatctctcatgaggagatgcgtccccctgcctcactgtggtggcctcagggatgagggatcaagacctcccccagcatgatgaataaacctggactctcagcaacgcaggtgaaaaggatcctcacacaccatggcaaccaggtaactctgtacacaaaccaaggtaagaaaagtcgtgggggtgacaaagtatttccttggtggttgggacaacttggagcttgaatgtgtgtgaatgagatgtacaattaagcacaaagcaagcgtggagtctggatctgcagttctgtggtcacctcatatggcttatggcagattcctgttgtggggcttataccgacacaccgatgctaagagggacttaaattcccgtgagggaagcagccagagaaggacaaagcaaaaggagagtaaaaaagacctccagtagaggggggttaagcctctagagaagggaaggcaagaaatatctaatacgaggagggactgagcctcagcaaacctctagagaagggaaggcaagaaatctctaatatgaggagggactgagcctcagcaaacctctagagaagagaaagcaagaaatctctaatacaagggattgagcctcagcaagcctctagagaagggaaggcaagaaatctctaatataaggagggactgagcctcagcaaacctctagagaagagaaggcaagaaatctctaacatgtggcattgagcctcacatcaaacctccaggatgggaaacaccccacgtaagacaggaaatgaaagatataaagctagtgatgataacaacattccctctggtagtcccttaggtctcatgttaacatactggagggacagtgaaaggactaaacataataaaaaacaacaaatgacaaaatattgttgtttcatttggaccacagagctcatcctcacaccctcagttttctggccaaagtttcagtcaaatgaggattgaatttgtcaacttctaatagagtatgtcaatgacaagagtcccatctcccaggaggaaatagattatgccctgtattggcagcagggacccatccttctttaccccctaaaagctataggaagtaagccagaaatcagttcctctgaggaaagtaagacctctaccccaaaacaatccaccaatgtatgagacccaccagaccacccacctccgccaaatcccccaccccaagcaggtgcacaggacccccttcactcaattcctcctccatataaccctgagtcaatgcctgccccaatgccccgtgccctccctaaccacacgtctgagtctatgcctcctccaggaaggctctagtgtgagacagaacagtgtaaaaaggatattcagaactccttttcccctccacctctaaggaatcagccccaactcttttccccttgagggaagtgccccttggaggagaaggaatcggctttgtaaatgctcccccttcactagctcagaagttcgaaatttaaaaaaggaactcaagaccgggtgcagtggctcaagcctgtaatcccagcactctgggaggccgaggcaggtggatcacaacgtcaggagattgagaccatcctggctaacatggtgaaaccccgtctctactaaaaatacaaaaaaattagccagacgtggtgacgggcgcctgtagtcccagctacttgggaggctgaggcagaagaatggcgtgaacccaggaggtggagcttgccgtgagccatgatcgtgccactgcactccagcctgggcaacagagcaagactccgtctcaaaaaaaaaaaaaaaaaaaaaaaaaaaaaggaactcgagtcattattagatgacccatgtggggtagcagatcaaattgatcaattcttagggccacagctgtatacttgggcagagttaatgaccatcctgggcatcctcttttcaggggaagaaagaagcatgatccaaagggttgctatggtagtctgggaacgtgaacatcctcctggccaaaacattcctgcagccgaccaaaaatttccagcccaagaccctcgatgggtcaataacaatgcagctcaccaagagaatatgaaagatctcagggaaatggtaataaaaggaattcaggaatcagtacctcagacccaagatatttcctgagcattccatatacaacaaagaaaggatgaaggacctatggaattcctagagaggctgaaagagcaaatgagacaatatgcaggcctagacttagaagaccctcttgggcagggaatactcaagttacattttgttatgaacagttggccagatattgctaagaaattacaaaagatagagaattggaaagactggactattgaagagcttttaagagaagctcaaaaagtatatgtgagaagagatgaagaaaagcagaaacaaaagggaaaaattacgttacccaccttccaacaggggttccaaaagacaaggcccactgatactactctccattacctacagaccccacacccctaaacaagggctacagggggccaaagcttacaaaggatttaagtcctcacatgctaaaccatataaaggacatagagagacaagaccaggtaacctcagaacagggagggagggaggacaaaatacatgcttcaaatgtggaggagcagtcattttaagagagaatgtcctgaatgggagaaggagaaagaagtcattccatttaagggagtcaggggctctattctttttatcttgaattctaccaagagcccttgataaacttagaggtgggacccaaacatgaagttataacccttttaacagattcaagagcagctcgttcctgtttgtttccctttacctaatgtcccttgctcctcagaagaactttttgtcttgggggtgaaaggagaaaggtttaaagcaagaatcttagaagacacagaggtcaaatataaaaattgatcagcccactttcaatttctgttaatccctgaggcaggaactaacctattaggaagacatttaatgctaaaactaggtataggcctacatgtcagtccaaacggatttctcacctcattaaatctacttaccactgcaaatgaaaaatatattcatcctgatgtatgggcgagagaaggaaatcgaggaagacttcaagttgctccaatacatatgaagttaaaacccccaggggaaatagtaagaagaaagcaatatcccattcccctagagggcaggataggcctaaaacctgtagtcgaaggtctcattcaagataagcgccttgaacactgtatgtccccttataatactccaatatagcctgtaaagaaattagacgggtcatgctgactagtgcaaggccccagagctattaactaaacagtccagactacccaccctgttgttcccaacccttacactatcctcagcaaaataccatatgaccatcaatggtttacagtgatagacttaaaagacaccttctaggcatgccccttggctgaggacagcagggacatatttgtttttgaatgggaagatcctcattctgagcgaaagcaacaataccaatagatagtcttgccccaagagtttagagattcacctaacctctttggtcaaatcctagaacagattctagaacaaatttgtacccccaaaacacatatgcttgctccaatacgtggatgacctgcttatatctggtgaagctatagaacaggtggctgtcttctccacacaccttcttaaccatttacaagagaaggggttacgagtttcaaaaggaaagctccgatctgtggaacccaaggttaagtatttaggacacttaataagtaaaggcaagccaaggataaggcccgaacgggtcaaaggaatcgtgtccttacctttgcctaaaaccaagaaagaactcagaaaacttttgggattagttgggtattgctgactatggattgattaatatgccctagagatgaaacccttatacctgaagctcacccaggaaaagcctgactttctcctatggacttctgatgaaatccaccaggttgaggagctaaaacacctactcatcactgcccctgtcttagcccttccttccctagaaaaaccatttcaccttttcattaacgcaaacaagggggtagctttaggggtgcttactcaagaacatgggggccactgacaacctgtggcctttgtatcaaaagtttttgacccagtaacctgtgggtggcccaaatgtgttcaatttatcacggctaccgccttgttaactaacaaaagcaggaagctaacctttgggggaaacttggtggtgaccacaccccatcaggttagaacaatcttaaaaggcaggaagatggctcaccgactcaaggattttaaagtatgatgctatcttactagaaagaggtaacttaacattaaccactgataattcacttaacccagcaggtttcctgacagggaacccaaatctaaaaggccctgggcgtaaatgtttagatttaattgattatcacacaaaggtcaaggctgatttaagagagacccttttcaaaacaggacatctattcatagatggcccctctagggtaattgggggaaaaaggagtaatgggtattcggtggttgatggagaagctcttgcagaagtagagtcaggaagattgcccaataattggttggcccaaacatgttaatgcatgtttaacatgcattaaatcaggctttaaaacatttacaaaaccaagaagggaatatttatactgattctaaatatgtctttggggtagcccatacctttggaaaaatttggactgaacaaggtctcattaatagcaaaggccaagaccttgtccacaaagaattaatcacccaggtattagataaccttcagttgctagaagaaatagctattgttcatgtcccaggacaccagaaaaatccttcttttgaaagccgagggaataaccttcagaccaaatagccaaacaagctgccgtttcctctgaaacgcccgtttttcacctccctccttgcctttctccccctaccgccattcccatcttctcccccgctgaaaaggagaagttaataaaaataggagccaaggaaaactcagaagggaaatgggtgttaccagatcaaagagaaatgctatccaaatgtctcatgagggaggttttatctcagttgcatcaagaaacccactggggacctcaagctctgtgtgatgcagttcttggagtctccagatgtagaggaatttatactctagcaaaacaagttacagataattgtttaatatgcaaaaaaactaataagcgaatcctaagaaaaccacccatcggaggaagaaccctggaatagggccattccaaagcatccaaatagattacactgaaatgcccccaataggtcgcctaaagtatctacaagtaatactggatcaccttcctcactgggtagaagttattcccttttcaagtgcagccaccagtaatgtagttaaggcattaatcaaaaatatcatacctaggtttggatcactagaaaatattgattcagataatagaacccacttcgctgcacgtcattaaaaagctagcccagctattagaaataagatgggaataccataccccctggcactcaccttcatcaggaagagtagaaagaatgaactaaaccctaaaaagccaccacaccaaattaactttagagactcgactaccatggaccaaatgccttcccattgccttactgagggtctgaactacccctcggaaagatattggcttatctccttatgaaatgctatacgggttgccttatttacactccactgctgacattcctacgtttgaaactaaagatcaatttctcaggagttacatacttagtctgtcttccactttctcttccctcagaactaaaggccttttagcagagacaccacccttggagttcccagcatgtcagcatcagcctagggatcacgttctcatcaaaagctggaaagaaggaaaacgcgaaccagcttgggaaggaccctatctagtgcttctaactacagaaaccactatctgcacggccaaaaggggatggacagaccacacgcgagtgaaaggagtggcttccacagccagagaaaaatgagccgtcaccccagggcccacccccaccaaattacctctaaaaagggcttaatattattttcccttttctttccaacagaaggtcaccttgtcatctatgtgactcaaactaaccatcccttaacccttcagtttgacgcttgttcagtcatctcatatggagatgaacgaactcaaaggcagctatcaaatgtagataagtatctatgtccgtactgtagtgagtcaacaaagtataagcatggagccttaaaaagtccctgtggtgactggacagatgtttggtggaccacccaatatggaggatggacagccaggcccccttcttcaaacaagttgcaaggactgaaacagaaactccaacttacgtggtcccaccccatcaaattgtaagtcactgcaatgtaaccccttatccccttgttgctaattatagataatccccaaacaatggcccaagaaccctccatattcgaatggtatgggttaggagcagatgttataggacgggaccccataagaatcttctctctgagtcggttgaaaacaataaagaaatccagacccagagtccggggaatatatgggatccaacactttccccaaacatatcatgcccagcattctcctcccatctccagaaccacccaactaaggtaacggctgtggaggtgaaagaattaaggcagactatagctctagagacaggatacaaagatgcaaatgcctggctgaaacggattaaatattccatccgcactctaaacaaaagagattgttatgcttgtgcgcaccgcaggccagaggcccagactgtcccctttccactcagatggtcctccagccgaccaggcatgaactgtatggtagctctcttccaacgccccacagcctagggtaatgaattatgccaagctctctcttggctattccctgaagttcggcaccctatgggtcaggccctgagggccacgtcaattttacctcatgtctctcacaacaaggggacaacttagcatttcttggagacctaaagggatgcagtgagtttaagccattccgagagctgacctatcagtctgccctgatccatccgcaagtggatgtatggtggtattgtggcggaccatcactggacactctgccaagtaactagagcagcacttgtgctctgatccaattggccatccctttcaccctagaatttcatcaaccaaaaaggataaagacaaaggattgtataacaagagatagccctcatgggtcctttgaccctcacgtttatatagatgccactggagtcccgagaggagtgccagatgaatttaaggtgcaaaatcagatagtgcagggtttgagtccatactattctggtggttaactgtaaataaaaatgtagattggataaattacatctattacaaccagcaacgatttgttaactatattagagatgctagtaaaggaacagctaaacaattaggacctaccagccaaatggcttcagaaaatagaatagcattagacatgatactagcagagaaaggtggagtttgtgtcatcattggaactcaatgttgtacttttatacctaataatactgctcccgatggaaccataacaacaaaagcattacaaggtcttactgctttatccaatgaactagctaaaaattcaggaataaatgatccctttactaatttttttttttttttttgagatggagtcttgctctgtcacccaggctggagtgcagtggcgctatctcaactcactgcaagctctgcctcccgggttcacaccattctcccgcctcagcctcccgagtagctgggactacaggtgactgccaccaagcccagctaaatttttttttgtatttttagtagagatggggtttcaccgtgttagccaggatggtctcgatctcctgacctcatgatccacctgcctcagcctcccaaagtactgggattacaggcgtgagccacagtgcccggcctccttcactaatttaatggaaaaatggtttggcaaatggaaaggacttatgtcctcaatccttacttctcttgcctttgtaacaggtgtgcttattcttgtaggatgttatatcataccctgtgccagaagcctagcacaaaggcttattgaaacagctcttattaaaacctttttcaatctccccaccaccttattcagataagctcctacttttagaaaaccaggcagaataacagagtcaagaaatgttaaaaacgtttgaagaggaagaattataaaaatcaaaagaagggaactgtcagatatggctaagttcctcttcaaaggtttaatttgtaacttccttgttctttgttctcgagatcaacttccttgtctcttcttctaagctacctgctctgtaaacaacttctcctgcgagtcccaatctgtaagtcacatctcttccttatttggaaagcgtcctcttcactcctgaccacccattctgtaaactgcccctcccgccgaaacagctcttcccatcaaaactacccttcctgcctttgccgcgccctgacatgcccaaacacgtcttgtaccgtaacaaacagcctcccccttcctacctaattattcatattcaattttaaacagtagccagttgggtcagtgtagattgtgcagtctgactccagccaatggggacacgacacagaaccagggaataaccgcgttagggataaaaaccccttccctactttgtttggtgtgctctcgcagtggccaaaagtgcaagcagcacccttttgcagaagtaaatttgccttgctgagaaatccttcgtttgagtactcattttccttatgactccgagctcttgtttctaacaagcataataaaatacctgctttacaccactatgttttggaagactatattatacagcaacagtaaatgaaataatgccacaatttcatgaattttggcataatcttatcaattccaagtattcagattcatttataattactaaatgagtaggctactggtataatagttatgacagctctaaatctatggatccctttttcctctttataaatttttaaacttaactagaccagaatataacagtcctatatcctagccttagccctactggttactatccaagttatttaggaaatttacaagtctctctacacctcatttcaaatggaagtaacacttttctcacctgcctttttaagatggttttgtggactaaatgcaggaacatgtgaaagcattctgaaaacagtaagatactatacatgtaatatattttcacttgtggaagtcctcatcaaaagtctatgctttttaagataccaaaatttcaggaaaaaacaagcagttcaacagatatattttgtcacctactttgtaacattgactttatcttgataagacatttaggtcaaaaattaatattttaatgtgcctaaatgttaaatatacttaatataaaacctgccaagtcatcccccaccatcaccccctgcaagcactatattgacaccttttaataaactggtttatatttcagtaaaaatgcttcctaggctaggtgcagtgggtcactcctgtaatcccagcactttgggaggccaaggtgggcggatcacctgaggtcaggagttcgagaccagcctggccaacatggcgaaaccccgtctctaataaaaatacaaaattagccagatatggtggcccatgcctgtaagcccagctactcaggagactgcggtagcagaatcactagaacccgggaggcagagtttgcagtgagcggagatcacaccactgcactccagcctgggcaaccagagcaagactccgtctataaaaaacaaaaacaaaaacaagaatgcttcctagcggttactgccaaggttaacaggggctcatactatggctaacatagggaaaagataaaccaagaggttttttagggagttttgtggattaaaatggctcagtctagccaatctaacagtaaaataattcataaagtaacaatgaatgaatcagtttaattactctgcattttctaagatcctgagctatccggttctcatcacctaccagctactgtatcatcaccaactaaagaatgtcttctcccactgcaatgctgcactaaaataaaagggagtagggtaggagcaggacttctaaaactcaacagctaaaaacaactcaattcaaaaatggacaaaggacttggatagacatttctccaagtacatacaaatggcaaatatgcacatgaaaacatgctcaacatcactaatcattaaagaaatgcaaatcaaaactataatgcaatgccacctcacacccatcaggatggtcactataaaaaaaaatagtaataatagtaagtgcagatgaggacagggagaaactggaacccctgtgcactgctggtggggaatgtaaaatggtgcagctgctgtggaaaacagtttagtggttcctcaaataattaaaaatagaattaccatacgatcccgcaatttcacttctgggtgtatactcataagaattaaaaaacagaatcttgaagagatgtttgtatactcacagtcatagcagcatcattcacaatagctaaaatgtggaagcaatccaagtgtccattggagaataaatgaataaaacaccatgtatacatacaatagaatattactatgccttaaaaaggaaaaaaaatctgacatgttataacatggacaaaccttgaggacattacgtttagtgaaataagccaatcacaagaagacagataatatgacacgtaagtcaaataataagacatataagtatgattctacttatatgagaaatctagagtagtcagaatcttagaaagcaagatggtggttgccaggagctgggggaagagggaatagtgaattactgttaaatgcatatagagtttcagttttgcaagatgaaaagggttctctggagatagatggcagcgatggttccaacaatattaatatacttcatgccactggattttaaaatggtcagacagtatgtattttaccacagtaaaaaaaaaaaaaaaaaaaattggggatggggacagtggttcatgcctataatcccagcactttggaaggccgagacgggaggatcccttgagcccaggagttcctgaccagcctagggaagatggcaagacctggtctctacaaaaaaaatgtaaaaattagctgggcatggtggtgcacacctgtggtcccagctacttaggaggatcacttaagcacagaaggttaggctgcagtgagctgtgatctcacaactataccctgcctgggtgagagacagagagaccctgtctcaaaaaaaacaaaacaaaacaaaacaactgggcagggcaaggtacagtgacacacacttacagtgacacatacctatagtcccagctactcaggaggctgaggcaggaggttcacttgaggccaagagttcaaggatgcagtgcacaatgatcatgcctgtgaataaccactgcactccagcctgggcaacacagtgagacccccgtctactaaaaaagtaaaaaataatttttaaaaattgggacaaaaaatttaaatttcttcaaaaataaataggggctgaccctcaaacatgtagaaataaaaatacacacacaaaaagaacattctcatacagttgtaacagaagaaatacataaagtcaatacaggctctcttctatattagcaaactagctcatttttgataacctgtgtcttgacatgttggaactaacaggcacacacaatgctttcaagaaacactttacaactgcatctatatagcaatatccaattgtttacaaatacagttttcactgaacactgctttaaattataatcccattatatacagcaaagtttttctaatttaatcagatttaaatagaacatagcaaaactgagttatttgtaggtgatttatctatacagaaattatcattttattaataatcaccagtgatgcttcctctccattttcactaccaccaccctactgaaagcctattataaccttcttcaaatgaaacagcagccccaactcctgccagtctcccaccagtgtggagttagtccaccttattactttcaacccccttcctctgctcaaaatgctcaccaacgtcctatctctgaacgaccccaggctctttcctagcaaacctacatttcttcaagccccctccagggcttactcagttcaaagggcttactctacctgtgggtgtgtaccattttattttctattttattctgattaaataaatctgattaaattagaaaaactttggtgtatgtaatgggattataatttaaagcagtgataagtgaaaactgtatttgtaaaaaactgaatattgctatatagatgcaattgtattttattctatttatttctaaaataaaccattttattttctatttctgtgaccactcacagttctcccctttcttggcatttcttctcctacaaactctgccaatccaaagtaggcgcattcatccttcaaagctccctcaagtctcactacaagaagccttgactgaattctccattcattaggccaatgcagtaactgacctttagatgtacaactgacagtgcttcatcatgcaaacacctatctacttgctacttatttcgaatgtgaacattacctccctaactgtgtaacaaacaccttaaagcccatctcatacttctggcttctccacaattaagaatacacagacaccgggcacggtggctcacgcctgtaatcccagcactttgggaggccaaggcaggcagatcacgaggtcaagagttccagaccagcctggccgacatggtgaaaccctgtctctactaagaatacaaaaattagctgggcatggtgacacatgcctgtaatcccagctactcgggaggctgaggcaggagaatcacttgaacccaggaggcagaggttgcagtgagccaagatcccgccactgcattccagcctgggtgacagaacaagactttgtctcggtggcggtgggggaagactacatagccatatccaaattaagtccttattatatacttattaactgagttaataaaaataatatatacagtaaattagaatattatattttaatggctttaacattaatgtgcatatcatttgaatactgtttaatcatatccaaaagcttaatgagtgtgtcctaatgttcaagaatttaaggataaaaagagattgattcttattaatttttcacctttcagattagcaaaaattaaaagaccaacaatacaatgctgatgagtgtatagggaaaacagtacctccacacacacaaatggactacaaattggtgcaatgctgtggaagctactgtcgaatttccctctaaaggtgaatatcaaaatataaaatattcatattttgacccaacaacttcacatccgggcatttatccttcatatatatgtgtacaagtattcagaaatatatgcaaaagttgttcatagctgcaatgtctgtaaaactgcaagaatagtgcctgatacatgctatacacaaaaatacttctgaatgaataaacagtgaaagcccattgaagatgtacatcaaaaaagtactgggtaagttacggtacatctataagataatagaactactgcaataaatctgctgtaataaatttccaggaaatactgttaagaaagattgtcacggtgcaaaactctagggaacactattcacagatattacaaacagaatagtgcccccactccctcaaccagacactctgcagttggaaaaggttttaagagaccagcctggacaacatggtgaaaccctgtctctactaaaaatacaaaaattagccaggcctggtggcgggtgcctagaatcccagctattggggaggctgcggcaggaaaaaaaaaatcgcttgaacccgggaagcagaggttgcagtgagccaagatcacaccactgcactgcagcctgggcgacagagggagactccgtctcaaaagaaaaaaaaaaaaacaaaaagagagaagagaaaaagcattaacataacacaagcggagaaaaaataaacttgatatgactctagctgagcaatgaatgagattacgaaggactgtccctttcttatgatttttgattccaaatattaactacttttgtaatctgaaaagaacaatgaagaaattaaggaatcaaaggttcataaaactttgaaggtatttcacataacaccagccagccagacatatcaacatttatgatgcatataaacagcgaacaaagagtcacagaagaatacatataagaatataattatatagtgccaagcgcagtggctcatgcctgtaatcccagcactttggggggccggggcagaaggatagcttgacctcaggagttcaagaccagcctggacaacatagagagacctcctctccacaaataaaaaaaatcaaagcctggcagaatggctcatgcattttaatcccagcactttgggaagctgaggcaggcagctctcttgaccccaggagttcaagaccagcctgggcaacatagcaaaatctcatatctacaaaaaaatacaaaaaaattagccaagcatggtggtgcatgcctgtagtcacagctactcaggaagcctaggtaggaggattgcttcagcccaggaggttgaggctgaagtgagccaagattgtacactctaacctgggcaattaagtgaccctctctcaataaataataaataaattaaaatcagtcaggtgtggtggtatacacctgtgggtcccagcaacttggaaggcctgaggtgggaggatcacttgaacctgagaggtagagggtgcagtgatgccactgtactccagcctgaatgaaagagcaagaccttataaaaagaacaaaaacaaaaggaataccttatataaatttcagaagcaagctaactaaacttttttttacaaatacacatatatgatgaaataagcaaacaagagaaacacaaatccaggatagtgatttaactcagaaaagagagggctttaaagatatggtaatgttcctttttcagaaagtagcagcttcacaggtgttcattcccttgaatctttataacttaacatgttttatatacatattcctttatacagatagaatacagacaaatttttaaaacagaaaattcccaaaggatctcatgttttatttatttattttttatttttttttgagacagagtctcactctgtcacccaggccagagtgcagtggctcgatctaggctcactgcaagctccgcctcccagattcacgccattctcctgcctcagcctcccgagtagctgggactacaggtgcccgccaccacgccggctaattttttgtgtttttagtagagtcggggtttcaccatgttagccaggatagtctccatctcctgacctcgtgatccgcccacctcggcctcccaaaagtgttgggattacagatgtgagccaccgcacctggcctcatgttttttaaaaattatcttgccaggtgccgtggctcacgcctgtaatcccagcactttgtgaggccaaggcaggcagatcacttgaggtcaggagtttgagaccagcctgaccaacatgaagaaaccctgtctctactaaaaatataataaattagccgggcgtggtggcacatgcctgtaatcccagctactcgggaggctgaggcaggagaatcgcttgaacccaggaggcagaggttgcggtgagctgagaccgtgccattgcactctagcctgggctacaagagcaaatctgtctcaaaaaaaaaaaaacttaaaaaattgaagaggaaatcaagactgcctgtgagagcacatcaggatggttatttaaggaaagaaaatggagatttttgctagtttgtttttagattaggggattatccattttgttaacagtagaaccttagctacagagcactttatttagtattattgtatacactcatgttttcaagataccacaatttttcacttcaagtgataaaaaaaattttatatcaacccttttgaatagaaataaccccaagctgcaaaacaatatactaatgtatcttcttaaatagaatatactcattatgggccacaggcagtgggtcatgccagtaatcccagcagtctgggaggctgaagtgggcagaccacgaggtcaggagttcgagacgaacctggccaacatagtgaaaccccgtctctattaaaaatacaaaaaaaattagctgggcgtggtggcgggtgcctgtaatcccagttacttgggaggctgaggcaaggagaattgcttgaacttgggaggcggaggttgcagctagccaagatcatgtgactgcactccagccctggtgacagtgcaagactccatctcaaaaaaaaaaaaagaaaaaaaagagcatatactcattatggttttttgacatacagctactggtttcaaaatcccaagaggttctggaatgacatttttgacctcatgtctgtttttcgcgccactgcactccagcctgggtgacagagcgagactccgtctcaaaaaaaaaaaacagtgataggtaggattcctgaaaaacattgtttttagttcaagggtagaaagtgtataagccatgaggatacgtgtatttctggcattctaactgaagctacgaccaaaatgcagggagtttagttactcttctaaacaaaatatctctggcattattttatctaagccaaatgagatagttttgaacaccaaatatgaaaagttttattttagtaaatttataaagagcatactatttaactttactgaggttaataaaagagaaactctgtgatgaacagagcaaagtaagaaaatttctagttctatttgtgaaaaaagcaggaaggtaaggaaagagaaaaggacaaggcctctcccatgtctccctcttggagtaccactgagcaaaagcctactacagcatcttcacttagtcccccccagtcttctgtccatgtctctaaaacacattccactgtaaccactaccctacagaccctcttatcctctctgtcctgtgcttagccacattcctgaggggcctcatgaagcagggctacccaagccatatcactagtctgaatctttctcagaataatagaaagtaataaatttgctagtccttcaacatagataaggaaaaaaaatttttttaagtaataaatttataataactgctgggacagaatatataaatgaaccacgacattgtgcatgatactgtccaaatgccatgataaaggaggaattagaaaacaaattagggaaatacgttaaccagataaatcaactctttaaaaacaaggctaaagatgaaagtaaaatcataaaagacagacaaccgggtaataagcatttaaaatacttgctcttgttggccaggtgcagtggatcacacctgtaatcccagcactttgggaggccaaggcgggtggatcacctcaggtcagaagttcaagaccagcctggccaacgtaacgaaaccccatctctactaaaaatacaaaattagcccggtgtggtggcacatgcctgtagcctcagctactcgggaggctgagagaggagaactgcttgaacccggggaagtggaggccgcagtgagccgagacagcgccaccgccctccatcctgggcgacagaacaagactctgtcccccccctccaaaaaaaaacaaataaaatcgaataaaataaaatacttgctcctgttactaattttaaaaataaaaatttaagcaagatacaagttttcatctaaaaatcacagagatctgttttcaatagcacccagtaaaggcaaaaagtaatgagatatgacaagcattctctcactttgcttgtggaatttaaactggcactaaaataatttggcaatatgttatcaagagtctaaaacgttctttttacttgatccaataattctactcataggactttgtacaaacaaataataaaacatgaacaaacactcaatccttatttcaaagtgaacgtaataaagagataaaatgcaatactccacttgcttggatcaccagttttgctaaaacataaataaagcaaaaagcaaaaaattgaaaaaaaaaaaaaaatagccacattgcctgccactagtcaggccatactaaccccactaactagctctacccctcaaaaccttccgatttaaccaagacaggctgcagtacaatcctgtaagacaggtaaaaaagcacactgatatgtttaagtgttttcacatgactgaaaataaaaagggttttcccaagaaagaaaagaaagcaatcttccacatcaactatgaaatgttacttcccaatttatttcataaagaaattcaaatatatttgtaaataacttcattaggcagtaagaattataacacagcaatgcaaaaatttgttagtcacattgtaagcaattgatgggcattaaataaaagctaaaaaactgcatgtcaaactccctgtgccactttagaaataaaattaaatataaaaggtttatttcttagaaaatcagtttaaaagctacattaaatggaaagtaagtccctttataaaaatatgaaaagtatcaaaatacaaaatcaggatcaataaataagatttgtatctattcccattcacacggaagcaatctgatttctacaccataagaatgcttgagtaagttctagccagagcaactaagcaagaaaaagaaataaaaggcatacaaacagaaaagaaagaagtaaaattattcctgttcacagatggtaggctcttatatacagtaaaccttaaagatttcacacaaaaaacctgttagaataaatgaattcagtaaagtagcagaatacaaagtcaacacgcaaaaatcaattgcatttttataaactaataataaatatgatgaaaaggaaattatgtagtttttacaatagtatcaaaaagaaaaaatatttcaaaattaaccacgaaaatgaaaacctgtacaataacaactataaaacattgctgaaagatattaaagaacacataaataaatagaaacacagctcatgttcatgtactggaagacttaattttttttttccccatcagcctatgtgggaaaagaaagacttaatattgctaagatatcaatactacccaaacaaatttacagattcactacaattcctctcaaaatcccaattttttttttttatcagaaatagaaaaactcattctaaaattcacgtggaatctcaagggccccaaatagccaaaacaatcttacaaaataattaaagctggagaattcactcttcctgattccaagacatattacatagctacggtaatcaaaactgtgatactggcataaagacagacatctagaccaatggaataaatcaacagtcacaacctttttggccaggaccagtttcatggcagacaattttcccacaggccaggggaatggtttctggatgaaactgttccacctcagatcatcaggcattagattctcgtaaggagcatgcaatctagatcccttacatgcacagttcacagtagggttcctgcacctatgagaatctaatgccactgctgatctgacaggaggtggagctcaggctgtaatgctcgaattcctgctgctcacctcctgctgctcacctcccgctgtgcgacctggtttctaacaggctgtggactggtgctagtccacggcctgagggttggagaccttggaacagagaacctggaaataaaacctcacatacatggtcaaatactttttgacaagggtgctaagatcattcagtgagggaaaggacaggcttttcaacaaatggtggggaaaaactggatatccacaaacaaaagaacaaagctggacactcacctaataccatatacgaaaattaactcaaaagagatcaggcttaaatgtaagacctaaaactataaaattcttaaaggaaaacacagggcaaaaccttcacagcatgaagtttagcaatgatttcttggatatgacaccaaaggcataggcaacaacaacaaaaaataaacaaattggaatttcatgaaaaaatgttaagttgtacatcaaaagacactatcaacagagtaaaaaaggcaaaccacagagtgggagaaaatatttgcacattcatatatctgataagggattatatccagaatatacagagaactcctaaaactcaacaacaataaaacaaaccaattcaaaaatgggcaagagacttggctatacatttcttgaaagatacataaatggccaaaaagcacatgaaaatgcacaatatcaccatcattacagacatgcaaatcaaagctacaataagataccacctgacacccattataatggccactataaaaaaaaaaggaaaataaaagtgttgttaaggatgtggagaaactggaacccttgtgcactgttgaagggaatgtaaaatgcagctgccacggaaaacagtatggtgatgcctcaaaatactaaaaacagaatgactatgtgatccagcaattccacttgtgggtatacagccagaagaattgaaaagcagggtctcaaagagatacgtgtatacccgtgtccacagaattattcgcaatagctaaaatgtgggagcaacccaagtgtccaatggataagcaaaatgtggtatcctataacacagaaatatagaagtaaaaccagaagaaacagctaaaataattaaggttgttgcctcttgaaagtgagattgagggatgagtagtggagtgagcaaaagattactatttttctttaaaaatgtatactattgtattatttagcctttaaaaggaaagaaattctaacataaactacagcatgctagaaccttgaggacattacatttagtgaaataagccagtcacaagacaaatactgtatgattccaacgacatgaggtacttggaatagtcaaaatcatagacagtggaagtagaatggtaactgccaggggctagtgggagaggaggagaggaaggctattgtttaatgggtacagagtttcagcttcagaagatgaaaagagttctggagatggatggcagtgatggctgcacaacattaccaacatacttaacaccactcaactgtacactttaaaatgatcaagatgatacattttatattatgtgtattttacaataaaagaattggagaagaagaaagatcaaatgatatgaaataaagcttctattagatttcagtcatggttgccgaatttttatccgtatattcaaacattcggcattgatgcctcaatttcactatattaacagcacatcattaatcaatagttgaaggtctctcatttcatttactatcttgttcagaagaaactgaattctcaaacacttacctaaactcgtgggcttgatgagaacatcaaggacatcataaaagggcagattttttaactgcacatcaggatggacaggaggaattgggggagatggctgctgcatctcaaatgtgggcttagtatcttgaagcagcacagaaccaacaggagaggatggtgagtgaggtgtaactgaagtggaaggcaacgagtggattccagccacggccaagtcaggttctacaggtgatgagccaccatccaaactgaaaaccgatgatttgattgtggataaatcagaaagtccttcaagagttcgtggatatcggcgtctatacaattctcggattttaatctgaaccgcagggctgcagccgctcttcaataaatgcagcgccctcatcaggaggtcatgcttgcgtccacttttattccgtccagcaaagcctagtaatacttgtagttcagaaaccctaaaactagaaaccatattctaaaaggaaagaaaaaaaaacataagccaagtcaccctcaagcatacaaaaatcctatctaaaatataatgtaaaatgtgatttttccagcattctatcaattggcatgtgctagtaacagcatttcacataccacttagaatcattaccattcataagacaatcccgtaaaaattacattcaagttacggtgttaattatattttgttgtacaagatcttaattttggtaatctatagtctattggtttctactaaccacttcattatctgattatgctctaatgcaaacagttatttgctttatgactataaaatctatcaccaatgaatatactccttttcaaaaccaacccctcccaatatacaatgtaatgtttgttacagaattatcgccaattaaccaaacaaaaaatcagattttcacaatgttagatgtgtaacttttgatgctgagtagtaaatccataaaaatcaagtcagaactgtgatccaaaatgcaatgaattttttaccccaattcaaacattaacaaacaaacaacataataaagatattttaaaatattaaagctaaaaaatcacatacatcttatttagcagtcaaacttctaaaacaactgaaattcccagctgggtatccaaatgagaaaaagacctttgaagagcaaggaaatgagcagtcatcaatcttaaagggcaacatttcctccacactactctactggcttgtgcttgggcgtaaaacaaaggttataagcagttgcagcttcacatcacaccttctattttttcagcaaaacttaatgaatatttttaaccccttgcagcctcaggaatccacctacttagtgatttccagtcaattctgaactcagaggcaaatcacacttgggtcagataccacacatgcatcatctagcaagaaagaggaagaacacctggagctgaccaaagccctgtcagaaacctacccaggagaactacctgtggtttggtgtcccatcccatcctcatcactcccccaacccagcccgtgctacacactccacagtcacttgggattccttttcaacctgcttgtctcatcagtatagtggaaatgtggggcagttgctctgtactttttaagtctcagggacggcccagaagcaactgtttaaaaccctatatggtttttaaatacttgttggtataaatacttgctagtttactaaaatgcaaacagatttaaatatgccaaagtaatccatatacactgtcataactgtactttgtgtactatatatgtctctatatttcataatgtacaagtgagagaatattaaattgtaatcctggcaagccattttatactctaattcagtgctgtccaacacaaattaatagaagacacacattaaacctcctagtagtcacattaaaaaaactaatttaggccaggaacagtggctcacacctataatcccagtgcttttggaggccaacacaagaggatcacttgagcccaggagttcgagaccacactggacaacatactaacaccccgtctccacaaaaatttaaaaattagccagccatggtggtgtgtgtgcctgtggtccaagccactcaggagactgaggcgagaggatcacttgagcccaggaatttgaggctacagtgaactgtgatcacaccaccatattccagcctaggcaatattaagactgtctcaaaaataataataataataatgataatttacattaacatagttatttaacccaatatatcaaaactatcttttcatctcaacatgcaatcaatttttgtaatttaaaaataatcattttttaaagtgtcagtgggattttttttatactaagtcttcaatatctggtgtatattttacacttacaatacatctaaatttggactaaccacatttcaagtgcttaagagccacatgtggccactagctaccacactgtggtagctctaaatcatactctaatagaacacataccacaatgtgtgttacctctacagtgcagacaacaaagaaggaaaacaagaaaacttttggcctatctcataacaaaccagtcacagcttactcaacatctcatgcattaaacagaagacaacagcttcttgggaagggtttacccaagcaagtaatacgatgcatctttccctcaatcttagtaaatacttcaattgattgtggaacactaatactaaaaaaggcaatcacacagataaaacataactgattttttctaactcagaattcactactttgcttcactccttatacttattgtcagatattcttcattttaagggaagctattttacagaaatgacaaaacaaagcacaaagtcatcctacctaagcttgactctcagaggaatttctaggaggtctcatatctcatatttccagtgataacattatttggcaaaggatgttaatgcaactggctctatgggctgttgtaaatagacaaacaaaaagtaagaaagagataagagcttagactatgaatgcggaatcacagaattctgaacagcagatgggacagtctttgcattacaaaatgctgcaaagataaagtattgctggacacatagccaaaggtaattaagtcaacagggccctgtgaaaaacttcaagccagcaatcagcagttgtggttcaagcccaagcaccaagactttggaccctgggaaagtcatttcatccctctggtcatcaatttctattttaaaataacaaacaccccccaaaaaaatccctctccttggccaggcacagtggctcacgcttataatctcagcactctgggaggcaaggcgggtggatcatttgaggtcaggagttcaagaccagcctgaccaacatggtgaaaccccgtctctactaaaattacaaaaattagccaggcttggtggtacacacctgtagtccctgctactcgggaggctgaggcaggagaatttcttcaacccaggaggtggaagttgcagtgagccaagactgagccactgcactccaacctgggcgacagagtgagaccccatctcaaaaagcaaaaatcaaaaatccctttcctttatttagcacttactgataaaataatctcaaagcagcttactaagtaaaattctacaaatatgttgtttggcaaatcttaccagatcccacttcctctaggagtaatacctattttttcttaacttagtctttcaccaagtttcaggcccttcccccacagtgagtgggtgtggtgagtagagagggtcaccagagcccacatgggggttaaggttagcctgctatgaacactaccaagaatggatttcagttgtttttctccaccaacctctgatgttggtatctttagtctaattttttccaagcggtttttccactccactgcgctaactctcaaaggctcccaagtcagcccacttcagttaaaactgttattcctacagacgaatttccctacagagaaatgtgttggcataattaattgtgtaaaaagatacgtaatctaaattctaaacaaaaactaacataaattaagaccagagttttaagtcaaccttgttcctttatcaaatgaaaataaacacaaaattattaaaaattttaaagctgggatattatataattgaaacactacatacaaagatgaaggcaagctgaaggtgctacctcattaggtagaaaatacctcattaggctgggcgcggtggctcatacctgtaatcccagcactttgggaggctgaggtgggtggatcacttgaggtcaggagtttgagaccagcctgaccaacacggtgaaaccccgtctctactaaaaatacaaaaaaattagccaggcatggtggcaggtgcctgtaatcccagctactcaggaggatgaggcaggagaatcgcttgaaaccgggaggcggaggatgcagtgagtcgagaccataccattgcactccagcctaggcaacgagagggaaactccatctcggaaaaaaaaaaaaaaaatacctcatcaaacaggtatacatgacagttacatgtaatcaccagtgaataaaaatatttccctgagattgctcttcaattctaaaacatgagacagaagctgcaataacggcctagaatttggggaagtgctaataaggttagaaatcatggtaaaggtcaataagaactctgtagattccccatctgctatgatgtatataatacaggagaagacgagaagctgctgagggcaactgacaaactgcattattaatattgcctactccagctacaatattaaaataatctacctcaggacggacacggtggctcacacctgtaaccccagcacttcgggaggccaaagcgggcggatcatctgaggtcaggagttgaagaacagccaggccaaaaaggcaaaaccctgtctctactaaaaatacaaaaattagccgggtgtggtgtctcgcacctgtaattccagctactagggaggctgaggcaggagaaatgcttgaacccgggaagtggtggttgcggtgagcggagatcacactactgcactccagcctgggtgacagagtgagactccatctcaaaaaagaataataatcatctacatcttcatttataagtaggaataaagaaaaactgccagattaacataatccctcaaaaaagagtgaccaagctaatgccatacataagaggaactatgtggcaagccagaaagatactgcttactcttttcaaaggtcattggaggccccagttcctggtcctgtattcctggtgaaatcatgtaatccctataattaaatccacttttatttgagagactaatgggtttctcccttacaagataatgattacaataactcctaggttaaagaaatcaaattgaaaatcaactattaagagaaacaataaaaaaaatgctacattccaaattcagggaaaacatctccctaaatgcttctattattatacaacagagatttaaaataaagtagtcaattaaggaagcaaaaaagtaataataaaataaaccaaaagggctggggaagcattacaggataaaaagaaaaaagcaaaaaaaaaaaaaaaaaaaattaattagaaagcaaaatgcagtgaagtcagatccacaaaagggaaagtaaacaaacgtatggtcttataaatgaaaaaaaaaaaactaaacaaatttctttaaacaaagaaaatagtgcatgcaactatatattctaataacttaaatacagataaaagtggtttcctagaaaaatacaaattactccatctgattcaagaagaggtatattgtcttgccctccctccacatccaaaaacatctacccaaacaagacagcttcatgaataaattccaccaagctttcaaggaaaggatggaattctgttccttaaactgttcaagagaataaaagccagggagtaaaatacatacgtgttagaagacaaatatagaaaaatgctgaacacaaaacatgaaattcaaaaaacatgcaaattattggttttcaaacttcagcagggagaagtccaccctatccaaccaaacttttaggcaaaagcctatgaaatggcgggcctagtataccatacattctttctcatttatcaacatggaccataagaagtctttgtgtaacacaatttacaaaccaatattaacacatcaatgtttcctgtgagtgtagacataaaagtcctcaatgcacccaatacagtgtaatctaccaatataagaatggtttaacataaattaagtaaattgcttggttaagattatttctatccttacagtcataagattgagtatttatgtataaaattatacaatatatggagtttcctttcaaataatttgggggaagtaggtggggacatatatgacaaaagactggagttgattaacttctgaagctgtgtactggggacacgaagaattttctatcattgtaaatttaagagtgtttcaataactcaaaagtttgcttgaacaggggaaactgggtgtgggcatgtggggactctaccaccttcccaagttttctgtaaatctaaaggtattctagatttcattaaacaaaaactgttagtctgtttgaaggtgaggtaaaaaagcggttatggcataaatactatttcccataaaaggaacccagactccttggggaaataaatggctgactgcaggtctggggcaggaaatgcacaagataagcctataacattttatcgcaccagaaaacagagaagctatcaaagatcacggggccttgtcagaagggcaaagaaaacatccagaatgggctcctagtagcctaagatgagaaaatttgagcatcaaaaagaataataactgcattggattcaaaccgattaaatatagtaatgtttcattttattcataataatactttaaaaatcactgatctcctttaaaggatgttaagggaaaaattcatcattattctgacaactgatagagaaaatgcaaacagatttttggtttgagtagaaaagccatatgattaatggctaaatgctagaagggcatttgataaaattctattcattcctgatgaaatctctcaataaacaagaaaagaaagaaattctgttaacatgataactggtatctgtcagaaagcaatagctaatatactaaaaatgaaacactaaatcacaaagctaagacttctaaaatgtatactatgttctgtcatttgacagtattctaaaaattctagataatacaaggcaatataatttttgggttttttttttttgagacaggatctcgttttattgcccaagctggagtgtggcaacacgatcttggctctctgcagcctcaacctcccaggctcaagtgatcctcccacctcggcctccagagtagctgggaggccagcccagttaatttttacttttcatacagacagagtctccctgtgttgtccgggttggtcttaaacttctgggtccaagtgatccttccaccttgacctcccaaagtgctggaattacaggtgtgagctactacaccaaggcaatataattttttttttttgagagagagaatctcactctgtcacccaggctggagtgcagtggcaccatcttggctcactgcaacctctgcctctgggattctttgcctcagcctcccaaatacttgggattactggcacacaccaccacacctggctaaattttgtattttagtagagacagggttgccatgttggccaggttggtcttgaactccggcctcaagtgatccacccacctcggtttcccaaagtgctgggattacaggcatgagccaccatgcccagcaaggcaatataaattttttaaaagtaacatttactatttacaaatgacaagactctctctattagaaatataagacaatccactgaaaaatttaaaccaataatattaaggcaaaacattgaattttccgtatatcaaatacattttcaaatggctgaaaaagagtattaaaaaaaccgaagtaacacaaaaacataaaatgcaaaagaataaattttaaaattttgcaagaggtacattaaaaaactatagaataaaagaagctttgaggccgggtgcagtggctcacgcctctaatctcaacactttggggggctgaggcaggtggatcacctgaggtcagaagttagagaccagcatggacgacacggtgaaatcccgtctctactaaaaatacaaatattagccgggcgtgatgggagggtgcctgtaatcccagctacttgggaggctgaggcaggaaaattgcttgaatctgggaggcggaggttgcagttagccgagattgcaccactgctctccagcctgggtgacagagtgagactccatctcaaaaaaaaaaaaaagctttgaataaattaaacagactgtatcatgcatgttactagataaaaatactcaacactgaaaaggtatcaattgtttccaagttataaatataaaaaaattccaacgactggttaatgagttggagagcttaacagaccaaaaccttaataaagaattaaataaaacatataatatggcaggtcatgatgaataaaatgaacaaaaacaaaggaggaagggacacaaaaagtgaagaagtagaggatttgccattttaaaggggaaaggcctcactgaaatagtaactgaataagtaactgaagcaggaggaaagcactctatggatacctgaggaaaagcattccaaggcattccatagcaaatgcaaaagtcctgaagacaaaggcaggcctaacacactcaatgaaagtgaaaggcaaaaagctcaccactgccgaaccagagtaatctagaggaatgagttatttgttgctatttgagacagggtcttggctcagctgcccagagtgcagtggtgcaaacactgctcactgcagcctcaacctcctgagctcaagtgatcttcctgcctcagcctccagcataactgggactacaagcacacaccaccatgcctgctaatctttttaattttagtaaagatgagatttcattatgttttgcaggctggtctcaaactcctgggctcaagtgatgctcctgccttggcctctaaaagtgcataagccaccatgctgggcccagaatgagtattaaaatcacagaatgatgttcgtttttcacagaaaacaaatgtggggagggaggtagtcaactaaacaaacctttactatatgaagtaactatcaaatttgtgaggttaagaaaacacagatctcatcctgacagcatcaggaaaaatataaaaataagacagaatgaaaatgctgagcaatgaaggcatataaattggtagtagggtgcaagggtgcattttgggaggccaagtgggcagatcacttgaagccagaagtttgagatcagtctggtcaacatggtccaacatcgtctctactaaaaatacaaaaattggctgggcatggtggctcacgcctgaaatcccagcactttgggaggccgaggcgggcaaatcacttgaggttaggagttcatgaccagcctggccaacatggtaaaacacagtctctacagaaaataaaaaattagctgggtgtggtgtgggagcctgttatcccagctactcgggaggctgagacaggagaatcgcttaaacccaggaggcagaggttgcagtaagcagagatcacgccactgcactccagcctaggtgacagagtgagactccatctttaaaaaaaaaaaaagataatataggcaaggaacagtggctccaaccttttaatcccagctatttgggaggctgaggcaggaagatcacttgggccaggagttcaagaccagcctgggaaacaaagtgagacccaggttctaccaaaaaaaaaaaattgtttttaattaccacggcttggtggtgctcaactgtagtcttgattacttaggaggctgaggcaggaggataccctgggcccaggagtttgaggctgcagtgagctataatcatgccaatattcccagcctgggtgacagagtaagacctcatctgaaaaaaatacaaaatagaggctgggcacagtggctcacacctgtaatctcagcattttgggagaccgaggcgggtgaatcacgaggtcaggcgttcaagaccagcctggccaagatggtgaaaccccatctctcctaaaaatacaaaaattagctgggcccggtggcaggcgcctataatcccagctgctcaggaggctgaggcagaagaatcacctgaaccctagaggcggaggttgcggtgagccgacgtcgtgccattgtactccagcctgggtgataagaacgaaactctgtctcaaataatattaaaaaataaaaataaggaagaactaacaacaattcaatataatttcttccagaaaacagaagatgagagaatatttccaaattcattttatgaaactaatattaccatgataccaaaacaaaacaaagacaacacaaaaaattaaactacaggctgggtgcggtggctcacacctgtaatctcagcactttgggaggccaaggcgggcggatcacctgcggtcaggagttcgaggccagcctgaccaacatggagaaccccatctctaagaaaaatacaaaattagccatggcacatgcctgtactcccagctactcaggaggctgaggcaggagaatcgcttgaacctgggaggcggacgttgtggtgagccaggatcatgccattgcactccagcctgggcaacaagagcaaaactgtctccaaaaaaaaattaaactacaaaccaatattcgtcatgaatatagacgttaaaacccttaacaaaatattagtcaataaaattcagcaatatataaaaagaattaaacaccatggtcattatgcaccatgaccaagtggagtttattccagtatgcaagactggttcattatatgccactgctgctcagcattttcactgtgtcttatctctgtatttgttttgagatctatagaatacatcatattaacagttacaaaaaaccaaatcatatgatcaaatcaatcaatgcgaaaaacgcatttcacaaattcaacacctgttcatgatttaaaaaccctcaaaaacaagaatagaggagagcttcctcaatttgataaacaggtctaccaaaaaaataaaattaagccaatattatactcagggcggaaagattgctttccctctaatattgggactgaggcaaagatgcctactatcacccctcattcaacacagtactaaaagttctagctagcagaataagacaagaaatggaaataaaagcagtaagagttgaaaggaaaaaataaaactatatttgtagatggaatgattgttcacatagaaaatctcaacaaatctacaaaacaactcctagaacttgtgagttcagcaaggtcccaggatataaaatcaacacacaaaaaccaaccacatctttatacactaaaaatgaacatgtgaaaacaagttaaaaacatcaccatttataacactccaaagaaaattaaaatacatatgtaaaaatgtaacaaacacgtacaggacttatatgctgaaagctacaaaacactgaaaaaaaaaaaaaaaatctaagaaaatctaaaggccgggcacgatggctcacgcctgtaatctcagcactttgggaggctgaggtgggcagatcacctgaggccgggagttcgaaaccagtctcaccaaaatggagaaaccccgtctctactaaagatgcaaaaaaaattagccatgcatggtggcacatgcctgtaatcccagctactcgggaggttgaggtaggagaattgcttgaacccgggaggcacaggttgcagcgagccgagatcgtgccattgcactccagcctgggcaacaaaagtaaaactctgtctcaaaaaaaaaagagaaaagaaaacctaaacaaataaattcttcacggattggaaaactcaacatagtaaagatgtcaactttccccaaaccgatatataggtttaacataattcctatccaaattccaacaagatttttgtagatatagatgagattattctaaaatgtatatgaaaaggcaaaagaaatattaatagaacagccaaaacaatttttaaaaagaacagagggagaggaatcaatctatcccattttacaacttagctaggactgacagactgcatggtattagtggaagggtagacacatagatcaagcaaagagaatacagaacccagaaacagacatatacatacatacccaaataatttttgataaaggtgtaaaattaactcagtggaagaaagacagcctttcaatatatggtgctggatcaactggacacccatagacagaaaaatgaacttccacttaagtctcataccttatacaaaaataactccaaatggatcacagagtcaaatgtaaaaataaaactgtaaaacttttttttaataagcaggaaaatatttgggatctaagactaggcagagttcttagatttgacactaaaagcaagatccataaaaggaaatatgacacactggacttcacacaaactaaaacctgtgctacgcaaaagacccctttaaaaggaaaaaaagacaatcaacagactcaaagaaaatattaacatttgcaaacacatatctgacaaaggactactatctaggatatacttagaactctcaaaactcaacaggaaaagaaaaagaattcaattagaaaaaggacaaaagacacaaagagacatgtcatggattgggatatacagatggcaaataagcacataaaaatatgttcagcatcattagccattggggaaatgcaaataaaaacctcactgagatatcactagatacctaccagaatggctaaaatgaaaaacactgataacaccaaatgctggcgaggatgctgagaaactggatcactccatacattgctggtagggatgtaaaatggtacagccactctggaaaacagtttagcaagttctttaaaaactatacatacaatgaccacacaacccagcaactacactcctgggcatttatctccgagaaagatgtgtgcgtaagtttaccaaaaaaacctatgcacaaatctttatagcatttttattcataattatcaaaaaactgtaaacaacccagatgtccctcaacaggtgaatggttaaacaaactatagtgaattcatatcgtggaaaactattcagcaataaaaagggatgagctgtttatatacaacaacttggatgaatttccagaattatgctgaatgaaaaagccagacccaaaaggttatccactgtgtgattctatttatgtaatatttttgaaaagacaaaaatcatagaaatgaaaaagatgagcgggccccagagagtgagggaactggatgagacaggaacaagtgtgactataaaataacaatactttggagagagggatccttgtggtgataaaatggtctatatcttgattgtgttcatgtcaatatcctggttgtgatactgtactatggtctttaagatgttaactctgaaaaaaaactagagagagtatacagaatgtctctgtattatttcctagaaatgcaagtgaactgacaattatcttcattaaaagtttaattaaaactacaaggagtaagactatcagactagatttttaattttcttaaaattcaatggtattatatttgaaagagataaaactgaaataaaaggacacaaaaatgtaacggtgaggagaaattttttaaattaggcaaaactgacaaaaaaagaaaaataacctagaaggccgggtgcggtggctcaggcctgtaatcccagcactttgagaggcccaggtgggcagatcacctgagatcaggagttcaagaccagcctggccaacatggtgaaacaccatctctactaaaaatacaaaaattagccaggcatggtggcaggcacctgtagtcccagctactcaggaggctgaaacaggagaatcacttgaacccacgaggtggaggttgcagtgagccgagatcgcgccactgccctccagcctgggtgacacagcaagactccatccgtctcaaaaaaaaaaaaaaaacagagatgggggtctcactatggtacccaggctggtctcaaactcttgggctcaagtgatcctcccacctcagcctcccaaggtgctaagattacaggattacagttctttcatgtgctagtaataatgttaaaatatggtttaaaaatcgatagaactacaaagaaaaatgaaaaacgaaacaaaattctagtaaaagattaactctgctctcttaataaaaaataaagatatgagatttgaacaacataattaacaaggctacataatgaacatatataaaactgcaccaaaaaccaggcaatacatagtctcttcatgtacaaataaaaattattaaaatggaccacatttttaatagtctaaacatatttcaaagagttggcattatacacaccaattggcatcacactcaaacaggctgcctaaccaaaatgcaattacaaatcaacagccaaatcaactagaggaactctgtttggaaattaaatttttaaatagctcataagttaaagaattcacaacggaaaatagaaaaatacaagtaaaaataacggaaatatcacacacatcaaaacaaggaggcaatacgcagacattttatgatcttaaataactatgttaaaatgctgaaaattaatgacaggcacccagcttaagaaattagaaaaaaagaacagaactacaaaggaaatgtaagaaaagaaaagaagagcaaaaattaatgaaacaggaaggatacactaaagagcataaacaatatcaaaaacttgattctctgaaaaatctttaaaaattggcaaacttttagccaaaaattatcaagaaaaaaagaaggcattttaaaaaaagacaaggggatattaactacaagtaactgcaaagaagagattaacaactaaatgctacaaattcaagaatgtggatgaaatgaacaactttctataaaagtatgaactactaaaacaggtttgaaacttgaaaatatgaacagtcctacaaccaaagcaattgaagcattcctcaaagaaaacaatagtaataattttataagcaagttctactaaatatttaagaaacagacctttctaatgttacataaactcttccagaagagaaaaggtatattttttaactataggctagttttactcattatgagagacaaaaatcctaaattaaatatctccaaactgagtccagtgaaaaaaaggaacagatagatcagggttgaatttatacttgcaacacaaagtttgtttaaatattgggaaaaaaattaatataactcagcatgttaacagattacaaaagagaaataattttctcaaaagatgcagaaaaagcttctgataaaattcattcatgattttttaaattagcaaactaagaaagggaacatccttaacctgaaaagattatctataataaacctacagcaagcatcatacttaactgtgaaactttgaaagcattccctttaaaatcaggaacaagatcaggatgcccccatcacagcttctattcaacattgtactggagatcctagccagcacattaagacaagaaaaagaaagaaaaaaaaaaagcataagaattggaaaggaggaaacaaagaggtcattattcacagataggactgtctgcatagaaaaatccaaaagaaatctaaagataattaatcacaattaggagtatagcaaggttattatacaaagtcaaactgtacttctgtgcaccagcaaagtataattataaaaagttaatatttatgatttgctataaaaataatttgttagaaataaatctaacaaaatatttgcaatactttaactgaaaataacaaaactttattgaaagatgttgtaaaaaacctaaaagaaatggagattacaatgattgtggttaagaaaacttagcagcaaaatgtaattctctccaagctaatttacagattcagtgcatttcccatcaaaataccaacaagatgtatgtgtgtgtgtggggggggggggaggtgtataacatgaaaatatgattctaaaattacatggagaagcaaacaatcaagaagttccttgaacaattacaagccaggaggacttgtgctacttctgtctccctcaatgactgactagactgtttcataccaaccctccctgtgagaacttaacaactgaatataatattaaaaaacaaaaatctgtgtgaatgcaggaggcactacaaaggcagtaaggacctgagacaccaagactctgaaaagaaggagagcctgcaaagctgagtctcttgatgccttccccggagatatctgccaatggaaaagggcaatggagaggttaaaagtccagcagaactctgaatagactcaggggaaacaagagaaggtatgtgcaaaacataaccagcaagagatggtttccaagatgtataatgaactcctacgaatcagtatggaaaagacagatgtcccaatataaaaatgagtaaaagacttggcaagccactttacaaaagaaacccaaatggccaataagcacattcaaaggagcttgacatcattacttattagggagatgcaaattaaaaccactacacattcaccagagtgtctaaaattaaaagggtagacaaggatatggagcaactggaactctactatatcactagcaaaagggaatgaaccaactacaactacagacaacaataaggatgaatctggcaaacgaaacagaaaaaaaggcagaaacaacagaatacatatacagaaacagaatacagttgacctttgaataacaataacatatagttgaatattgaataacaataacatatccaataacaaaaacctgtgttagtcaaaggtcaactgtatcttgtcaactggtttgaactgtgcaggtccacttatacgcatatttttttttcaaccaaatgcagatcaaaaatatggtatttgcaggacgtgaaacccacatatacagagggccaacttttcctatacatgggttctgcagggccaacttcaggacttgagtacacatgattttcctgttgggagggtggatcctagaaccaatcccccaggtacaccaaggggcaactgtatatatactacacaggttccatttatataaagttcaaaaacaggcaatactaatctgttaaagttaggatagtaggtcgcttttggaagaatgaggtgaggttagccactggggaggggaatatttagagtgctggtaatgttctctttcttgacctgcacgattattattttgagaaaattcatccagctataatttcattatctgtgtacttcctatgtgtatgctatatatcaaaagaagtttggttttttattataaaaaatattatcttacacagagatggggtctcaccatgttgcccaggctggtcttgaactcctggctcaagtgatgctcccaccatggcctcccaaagtgatgggattacagccttgagccacctcaccaggcaagaagtttgtttatgctagcagcagcatcatcttgttttagttactgtaactttttaacaatttctgtaaaaacagactaacggcccagagtccagaaccaaagcacagatgagtgatggcatccaaaccagtgaagaaaaaaatttgcatgaaaggtgatggaacaatttattattctttgaggaaaaaccatgcatcttggtcaccacttcacactgtatacaaaatcaactccaggtggattaaaaccttaaatgagaaaaggtaaaaaaaaaacaaaaacaaaaaacaaaaaaactacgtcttatacttttacaataatggaaaatatcttcgagaactctgttgaaaaatttcttcaacaagattcaaaagcactatccataaagaaaagcctgataaatgcaatcacataaaaattaagaacttctactcatcaaaaaacgcataaggctggatgcagttgctcatgcctataatcccagcactttgggagaccaaggtgggcagatcacctgaggtcaggagttcgagaccagcttgaccaacatggtgaaaccccgtctctattaaaaatacaaatattagccaggcatggtggcgggtacctgtaatcccagctactcagaagtctgagacaggagaatctcttgaaccttgggggtggagggtgcagtaaactgagatcacgccactgcactccagccagggctacagagtgagactccatctcaaaaaataaaaataaaaatgatttaaaagtgagcccaattgaaaggagaaatttgcaccacatgcatccaactgtgaaactattaaaaatcagtatgaaataatttttttaaaaaactagtacaaacatgggcaaaagacatgaataggaatgtgagaaaagggaagaatggctaatcagtatagtaaaagatgctcaaactcattagcaaagcaaatgaaaactaaaaggtggtattttatactcgtgggtaaaaacttttttttttgaaacagggtctcactctgttgcccaagctggcgtgcaatggcatgatcacagctcacttcctagcttcaggtgatcctcccatctcagcctgccaagtagctgggactacaggtgtgggccactatgcccagctaattttgttttgttttggtagagatggggtttcaccattttacccaggctggtctcaaactcctggtctcaagccatccacccaccatggcctcccaaagtgctaggattacaggcgtgagctaccatgcccaaccgataaaaccttttgaagtgtgacaaaagtagatgttagcaagaaagctgagtaatgaaaacttctgcattgctggagagaacgaagactgacaccaccttttttggaagataatctgacattatccaatattggtgaatatgcacacattcttcttaaataccagcaattctattcctagaatctctacagtgaaacatacaaatattcacactaagtgagatcaacaaagattacaatatcagtgcaggtcagggtttttctgcaagacaagtttggtgaaactttacagtttttttctcttcattttcaaacatttggatttaagaaatatggatggccagacacagtagctcacacctgtgatcccagcactttgggaggccaaggcgggtggatcacctgaagtcaggagttcaagaccagcctggccaacatggtgaaaactaataatacaaaaaaattagccgggcatggtgcacacctgtaatcccggctactcgggaggctgaggcagtaaaattgcttgaacctgggaggaggaggttgcggtgagtcaagatcgcgccactgcactccagcctgggcaagaagagcaaaactccgtctcaaaaaataaataaataaataaataaattttacatatgtatatatgttaaaagtataaagacagaccaggaatgatgaatccaaaattcagtacaatggctactgtcattggtgaaggtggacatggttgcagtggatgtgatcaggaaagtgcatcctgctaaagttacactaatgaattagtaaactggttggtaattatatgtatgtttgtttacatacgccttacctgttataatcttttgtacttatcaaataacttaaatatttaaaatacaaaaattagtatggaatacctaaatacaaacccactgttagagtcaccaattcagggaagtgtctcaagaactctagagaaattagcatcagagaaattcaaggtatttccccataaatcaaggacaggttgctatttaaaaagaaagaaaaatgaaagatgatagaagaactcttataaattaaagataactactgaaataaattttatagaaaagttcaaagacaaaatcaaagaaacctttcagaatgtaaacaaatcccgtagatcgtagactacaattgtagattacaatcttctacaggagaataaccatcagatctgcaatggacctctgattagcacaccaagtattttagattcccacagcaaagttttcaaaattctgaggaatttataattccacatgtaaactttcaatcaggaacaaagacaagccattttcaacattcgagaactcagaaagtttatcaccagcatatccttccagaaacaactattgaaggctgtattcctgtaaaataaaaaaggtatctaaaagagaaaaacatgggatccaaataacaatagatctaacccaggagaacaatgtgaagtaatcccaggatgacagctgggtaacaggtctactaagcttcccaaattagaaaaggcaggccaagactccggaaagtctaccaagacaagctgaatggctacaacatgagaacccattataatattaaattttaaaaataacttcaatgagctttcctcattcaaccaggactttgttatatttcttttttttttttttttcctgagacgaagccttgctttgtcacccagcctggagtgcaatgacatgatcttggctcactgcaacctccacctcccgggttcaagcaattctcctgcctcagcctcccgagtagctgggattacaggtgcccaccaccacgtcgggctaatttttgcatttttagtagagacggggtttcaccatgttagccaggctggtctctaactcctgacctgaggcgatccgcctgcctgggcctctcaaagtgctgggcttacagacgtgagccactgtgcccggctgactttgttatatttcctttttaaggatcacaggtttaacagaagtgaagtttctctatggctccacagtacttggttctatagtaactaatactcatgtcaacatacatatttaaaagagtggctattagtactcaatttctagattttcctgcagaagcacagaaaactttagaagagttataaaacattatataaatgcaataaatcttgccaatgtaacagtactaaccaaaaacaaaggctggggccgggctcagcggctcatgcctgtaatcccaccactttgggaggccaagggagggggagtggatcaccggaggtcaggagttcaagaccagcctgaccaacatggtgaaaccctgtctctattacaaatacaaaaattagccaggcatggttgcaggtgcctgtaatcccagctaatcgcgaggctgaggcaggagaatcgcttgaacccaggaggcggaggttgcagtgagccaagatggcgccattgctctccagcctgggcaacaagagcaaaatcctgtctcaaaaaaaaaaggaaaaaagaaaacaaaggctaggaagggaggagggaaaaacaaaggcaaggtttggcttttaaatcccaaaaggaaagggatcggtgttatatctttttctgaaagaccaggaagtgaggaaatatagttgtctctcagtatccgtagggggctggtaccagggtcccctgcagataccaaaatccaagaatgctcaagtctcttacatgaaatggcatagtatttgcatataagctatacacatcctcctacgtactttacatcatttctagtttacaatacctaatatatggcaaatgctatgaaatggttgttatactatactgtttaggaaatactgacaaggaaaaaagtctgtacatgttcagtacagatgtaaccaaccttttttcctgaatatttttgatccaaggttggttgaaaccaaagataagtcattcacagacatgaagggccaaatatactgtctaaaagtgataggtcaataaacagaaatttataataaaaagttaaaaataacagcaaaattaggaaccaaaatgtaactgatagaaatcaaagtctaggacaggtggaaaatgacctaaatttcttatctagcaaaaagttaagaaatattttttttgagttgaaaaaatatagagagaaaggcatggtatatttttagacttttggaacaacaataaaaccctaaaaacaaacaaacaaaaatggttaaaagcataatgggagtgggatttaatggaaaagggaagactttcactattttgaattttttcagtactgtctgcacaaatattgctttcatttaaaaaatatgagaaatggaaatgagagaataaaaaatgtgacatcaggtgatccacccgccccaggctcccaaaatgctgagattacagccttgagccactgcgcccagcctatttcactttaagttaaatatattttgtttcgaacgtgctttcatagacatgagctcaggtgaagccttggaaattttagttgcatcccataatagctttgaatcatatggaagattctgttatatctatcatagctattagtctgtatccctgcccaataaatggggagaggagcgtgatgaggacctctaacctcaaatcccccattaacttcccattctcctgctgcatcctaacagcacttgaagttatcaggatggtgactcctggtaggtgtaaggaaaccaaacacttaagccttctagacagaagaccttctgttacagaattacttaggcttcttagcatgaaagacccaaatctgatcttcgaattatgacacaacaaatttacccagtttggtaaatgttctggtttacccagtatctattgataaagttatcatcgctggctctctcaggccaaatgcacaaccagattctcacaggcacattctctctcattctgagacacacacagaataaattctcaatgcatgaaaagaaggggatgaagaatacagaagggagatccttaaaaaaaaaaaaaaagtcactacaatagatccccctcctccccattgagtgatgagaagtagggaaagtagattaaccaggttaaagtgtagcagggacctttttgtgaatgactgccaccagcagaccacaatattggaaatatgcaactggaagggtaaagaaaaagctgctctggttaaagaagaggtaagtgattccagaaactcaactcctgctctcctccatccctgtgcttagctcttctacagactagtttgagacagggtctccctctgtcgctcaggctggagtgcagtgtcaagatcagagctagctgtaacccagaaatcctggcttcaagcgatcctcttgcctctcaaagcgctggaattacaggtgtgagctaccaagccctgccctccagaccatttttggaggaggaagcaaggcagcagtgacagaagttcaggccatcaaatcttatgatcttgtcccacattaattcacaactagttaattcaaaatctgttcattcacaaactaatcactccttcagctcctaacaacacagatgccataaataagcaactggtaaattgagtaatttcttctctggcaccttgaaagcttctaatatataacacattattgtaaccatctttgagcacacaggccacattttcccttttcagagaacttccccacttcctttccttcaatccatcaggataatctgctgatcaggtttgtgtgctttgactctaagcccccggctatggatgattagaacagaagtagagacctaaactcagccaatcagattctctctcccagaagaactggaagagaggtgggctggtattctggtcacccggactgaaaggcaacaaggtatagagctgccatattctgctatgaccagccaagatctctggtactggctcacgcagcagtctccaaaactgaaatagtcaggcgacccccttaacagttgcctaatcgaataaccaaccctcccccccccaactccacccccgacacacaagtctgaaaagcaaaggcaccagggtcaccaaaccacactgaggattacctttcccaaaattccctatctccagtatagatgcagcactagccaggatatgaactgctctggttatacttgtccaaaatgagtagccttgaagggtaatggaaatcctctctgtggcatatcagcagccaaatatgtggcatccagatcggctgaccaatttctctactgccaagaagttagccaacaaactaatgcccaaaatttttcctggtcctataatttacttgagcatcactctgaccaccacaatatattctgatccaaggaccatcattttgagaatccaagattatttcttccccttttctttctttctattccgttttttagtctgtttttcttcctttattataatgtcacacaagaaggatgttaccaatcatttaatttaggagcaatcgcaggatgatggctagaagctccacctagaccccaaggtaccagaacaaagtagtgtagcccgggctctgaaaagcccagactctaaaagctacatgtctaagattaaaaatcttagcttttcaaatctcaagctgtgtgatttaggtcaggttaacctctctgtgcttcaatttcttgaaaaaattgtgagaattaaataagtatagaaaaaatgcttagaccagaaccaggcatggaataaccactatattaaaatgggtatataccatcatcatcattactgtctgtaatgggatgtaagggcggggtacagttcatcttcaagtgtagggtaacatgggtctgcacagagcagttaaggcaaagaaaagcagatgatgcttactgcatgtgcccagcctgcacccctcactcctctgaaaattctccccagttagtctctgttgggcacgtcatatgaattgtgggagaggggccatcttctaaaaatgcaagaagtaaagacagctgatttacaggaaaagaggatgaagctgatccacaaaccaaaacagagaggaaggcagaaaggaagagaaaaaaaagcttctttggtttctatcactttccagttgctggttgcactccaatctgagcactgactgcttttactctgctctataagagcgagtaaattcttcgctttacattaagctttggccaacaacattcacaagagtctaataaaaatcctggaaagttttcattaacaaaaaaaaaaaaaagaacttagaaaacttgtatacatctgttactacacaaaaattaaaaatggcaggtaaaaataaatataacttcagagttcagtcttctcaacccatcctaaatctaacgcatgaatttacagaggtgaggttcagggttcgttgtttgaaaagctccacaggtgttaaaagctctacagctggggctctgagccactaaaacccttaaacttatcaagtatgaacaccctttacctacacttatggttctctgcataaactagtatggggcataacatgtattaatatgtgtttactgggaacttaataattatttttgaaacagcaggagggaatatggcaggcactgtgcaaactccaacaatctccgtttagagcagaggatacgttcttttgctcacgtccactaagcaggtaaccagccaacatccttcccccatcccatctcttgcggaaaacaataaatatacaaaactgaaccttttaccggattcctcttccttatttgaaaaagaaatcctaatatcataagtgttacacaaacgagttgcagtaaatgtaatttcaagtttacactcatctctaccttgatacatttaaaaaaaaaaaaaatcagggtttctgtccgtaaacatctcatttatgtcgccagtaattcagcgatacacacaaatccatctcattcgtcacacttagttaggactttaaaggttatcagtctggggggaaaaagtctcttctgttctacccccatcacagccctattccagacctctgctatacaagggtatcaacaataaagttatgatcttgttttaagactgagaagaaaaaaatatttttcctcaagagtaaaaggggtgcacaaacctcacaacatagactttgcagatttcttactaaaacactaagaaaatatcgaggtttaaggccgattattgaaggcagggatccccaaacattaggttcctcgaagatgttaggaggcaagggtgggagaaggggccttttctcgtgacagacctgactaaacggtagcatcagccataagaagaggagagattcctaaacgcaacttcagctttcagaaaacagtcctccaccaagtgagtagcatgcagacttgtgaatagccacagacacgtacaccccggtgaaggtgcaagatcaaacgttgcttcccacatcggccctcactgcgaaccgggatgtcgggtccccatgtgcccctcctggagggcgccccgaccccccgcgccaggtgtgcggaccactggcagcactcaggagccggctcgccgcggcccaggcccgccgcccccgcgccgcccgcgtgccctccgccggcccgctcccctcccccgcgccctcggcgcccgttcgtccgcgggccggggctcagggctccgccaaccggccccagaggcacgagcaggcggcggccggcgacgttgcggtttccccacctcctctcccatcccctcccccgcggcctccgctctccactcccgcttaccctcaactcttcgaaatccgccattttataccacccgcgggcgccgccgccgctgccgccgcacccactcccgctgccgccaacgacgctgccgccaccacggccgccgccgcctccagcaccatcctgcactgggcgccgcttaagacgccgcggccgccgccgctacagccgggcccgtcacgtgaacggcgcgggagctccgcctccg
